US012649952B2

(12) United States Patent
Darcy et al.

(10) Patent No.: US 12,649,952 B2
(45) Date of Patent: Jun. 9, 2026

(54) NTRK FUSION MOLECULES AND USES THEREOF

(71) Applicant: Foundation Medicine, Inc., Cambridge, MA (US)

(72) Inventors: Christopher Darcy, Cambridge, MA (US); Anthony Classon, Cambridge, MA (US); Ethan Samuel Sokol, Somerville, MA (US); Xin Liu, Cambridge, MA (US); Erica Gornstein, Cambridge, MA (US); Mark Rosenzweig, Cambridge, MA (US); Rachel Erbach, Cambridge, MA (US)

(73) Assignee: Foundation Medicine, Inc., Boston, MA (US)

( * ) Notice: Subject to any disclaimer, the term of this patent is extended or adjusted under 35 U.S.C. 154(b) by 1170 days.

(21) Appl. No.: 17/613,818

(22) PCT Filed: May 22, 2020

(86) PCT No.: PCT/US2020/034421

§ 371 (c)(1),
(2) Date: Nov. 23, 2021

(87) PCT Pub. No.: WO2020/243021

PCT Pub. Date: Dec. 3, 2020

(65) Prior Publication Data

US 2022/0243280 A1 Aug. 4, 2022

Related U.S. Application Data

(60) Provisional application No. 62/852,583, filed on May 24, 2019.

(51) Int. Cl.
*C12Q 1/6886* (2018.01)
*A61K 45/06* (2006.01)
*C07K 16/28* (2006.01)

(52) U.S. Cl.
CPC ............ *C12Q 1/6886* (2013.01); *A61K 45/06* (2013.01); *C07K 16/2827* (2013.01); *C07K 2317/73* (2013.01); *C07K 2317/76* (2013.01); *C07K 2319/30* (2013.01)

(58) Field of Classification Search
CPC .................. C12Q 1/6886; A61K 45/06; C07K 16/2827; C07K 2317/73; C07K 2317/76; C07K 2319/30; C07K 2319/00; G01N 33/574; G01N 2800/52; C12N 9/1205
See application file for complete search history.

(56) References Cited

U.S. PATENT DOCUMENTS 3,687,808 A 8/1972 Merigan et al.
3,773,919 A 11/1973 Boswell et al.
4,366,241 A 12/1982 Tom et al.
4,376,110 A 3/1983 David et al.
4,458,066 A 7/1984 Caruthers et al.
4,469,863 A 9/1984 Ts'o et al.
4,476,301 A 10/1984 Imbach et al.
4,517,288 A 5/1985 Giegel et al.
4,676,980 A 6/1987 Segal et al.
4,816,567 A 3/1989 Cabilly et al.
4,837,168 A 6/1989 de Jaeger et al.
4,845,205 A 7/1989 Dinh et al.
4,868,103 A 9/1989 Stavrianopoulos et al.
4,873,316 A 10/1989 Meade et al.
4,981,957 A 1/1991 Lebleu et al.
4,987,071 A 1/1991 Cech et al.
5,023,243 A 6/1991 Tullis
5,034,506 A 7/1991 Summerton et al.
5,093,246 A 3/1992 Cech et al.
5,116,742 A 5/1992 Cech et al.
5,118,800 A 6/1992 Smith et al.
5,134,066 A 7/1992 Rogers et al.
5,166,315 A 11/1992 Summerton et al.
5,175,273 A 12/1992 Bischofberger et al.
5,177,195 A 1/1993 Gregory et al.
5,185,444 A 2/1993 Summerton et al.
5,188,897 A 2/1993 Suhadolnik et al.
5,214,134 A 5/1993 Weis et al.
5,216,141 A 6/1993 Benner
5,223,409 A 6/1993 Ladner et al.
5,225,539 A 7/1993 Winter
5,235,033 A 8/1993 Summerton et al.
5,264,423 A 11/1993 Cohen et al.

(Continued)

FOREIGN PATENT DOCUMENTS

CA 2880013 A1 1/2014
CN 113186287 A 7/2021

(Continued)

OTHER PUBLICATIONS

Bayer HealthCare Pharmaceuticals Inc., (2012). "Stivarga: Highlights of Prescribing Information," available online at <https://www.accessdata.fda.gov/drugsatfda_docs/label/2012/203085lbl.pdf>, 18 pages.
Chang et al., (2019). "ALK-positive histiocytosis: an expanded clinicopathologic spectrum and frequent presence of KIF5B-ALK fusion," Modern Pathology, 32(5):598-608.
Chen et al., (2023). "Abstract 74P: Tumor agnostic comparison of immunohistochemistry and next-generation sequencing in detecting ALK fusions and assessment of ALK tyrosine kinase inhibitor efficacy," ESMO Open, 8(1S2), p. 3.
Croce et al., (2019). "Uterine and vaginal sarcomas resembling fibrosarcoma: a clinicopathological and molecular analysis of 13 cases showing common NTRK- rearrangements and the description of a COL1A1-PDGFB fusion novel to uterine neoplasms", Modern Pathology, 32(7):1008-1022.
Davis et al., (2017). "Infantile NTRK-associated Mesenchymal Tumors," Pediatric and Developmental Pathology, 21(1):68-78, 11 pages.

(Continued)

*Primary Examiner* — Alexander W Nicol
(74) *Attorney, Agent, or Firm* — MORRISON & FOERSTER LLP

(57) ABSTRACT

NTRK fusion molecules, detection reagents, and uses and kits for evaluating, identifying, assessing, and/or treating a subject having a cancer are disclosed.

17 Claims, 89 Drawing Sheets

Specification includes a Sequence Listing.

(56) References Cited

U.S. PATENT DOCUMENTS 5,264,564 A 11/1993 Matteucci
5,276,019 A 1/1994 Cohen et al.
5,278,302 A 1/1994 Caruthers et al.
5,286,717 A 2/1994 Cohen et al.
5,319,080 A 6/1994 Leumann et al.
5,321,131 A 6/1994 Agrawal et al.
5,359,044 A 10/1994 Cook et al.
5,367,066 A 11/1994 Urdea et al.
5,393,878 A 2/1995 Leumann et al.
5,399,676 A 3/1995 Froehler
5,405,938 A 4/1995 Summerton et al.
5,405,939 A 4/1995 Suhadolnik et al.
5,432,272 A 7/1995 Benner
5,434,257 A 7/1995 Matteucci et al.
5,446,137 A 8/1995 Maag et al.
5,453,496 A 9/1995 Caruthers et al.
5,455,233 A 10/1995 Spielvogel et al.
5,457,187 A 10/1995 Gmeiner et al.
5,459,255 A 10/1995 Cook et al.
5,466,677 A 11/1995 Baxter et al.
5,466,786 A 11/1995 Buhr et al.
5,470,967 A 11/1995 Huie et al.
5,476,925 A 12/1995 Letsinger et al.
5,484,908 A 1/1996 Froehler et al.
5,489,677 A 2/1996 Sanghvi et al.
5,491,224 A 2/1996 Bittner et al.
5,500,362 A 3/1996 Robinson et al.
5,502,177 A 3/1996 Matteucci et al.
5,514,785 A 5/1996 Van Ness et al.
5,519,126 A 5/1996 Hecht
5,519,134 A 5/1996 Acevedo et al.
5,525,711 A 6/1996 Hawkins et al.
5,536,821 A 7/1996 Agrawal et al.
5,539,082 A 7/1996 Nielsen et al.
5,541,307 A 7/1996 Cook et al.
5,541,316 A 7/1996 Engelskirchen et al.
5,545,806 A 8/1996 Lonberg et al.
5,547,835 A 8/1996 Koster
5,550,111 A 8/1996 Suhadolnik et al.
5,552,540 A 9/1996 Haralambidis
5,561,225 A 10/1996 Maddry et al.
5,563,253 A 10/1996 Agrawal et al.
5,567,811 A 10/1996 Misiura et al.
5,569,825 A 10/1996 Lonberg et al.
5,571,799 A 11/1996 Tkachuk et al.
5,571,894 A 11/1996 Wels et al.
5,576,427 A 11/1996 Cook et al.
5,587,361 A 12/1996 Cook et al.
5,587,458 A 12/1996 King et al.
5,587,469 A 12/1996 Cook et al.
5,591,722 A 1/1997 Montgomery et al.
5,594,121 A 1/1997 Froehler et al.
5,596,086 A 1/1997 Matteucci et al.
5,596,091 A 1/1997 Switzer
5,597,909 A 1/1997 Urdea et al.
5,602,240 A 2/1997 De Mesmaeker et al.
5,605,798 A 2/1997 Koster
5,608,046 A 3/1997 Cook et al.
5,610,289 A 3/1997 Cook et al.
5,610,300 A 3/1997 Altmann et al.
5,614,617 A 3/1997 Cook et al.
5,618,704 A 4/1997 Sanghvi et al.
5,623,070 A 4/1997 Cook et al.
5,624,821 A 4/1997 Winter et al.
5,625,050 A 4/1997 Beaton et al.
5,625,126 A 4/1997 Lonberg et al.
5,627,053 A 5/1997 Usman et al.
5,631,169 A 5/1997 Lakowicz et al.
5,633,360 A 5/1997 Bischofberger et al.
5,633,425 A 5/1997 Lonberg et al.
5,639,873 A 6/1997 Barascut et al.
5,646,265 A 7/1997 McGee
5,648,260 A 7/1997 Winter et al.
5,658,873 A 8/1997 Bertsch-Frank et al.
5,661,016 A 8/1997 Lonberg et al.
5,663,312 A 9/1997 Chaturvedula
5,670,633 A 9/1997 Cook et al.
5,677,437 A 10/1997 Teng et al.
5,677,439 A 10/1997 Weis et al.
5,681,941 A 10/1997 Cook et al.
5,700,920 A 12/1997 Altmann et al.
5,714,331 A 2/1998 Buchardt et al.
5,719,262 A 2/1998 Buchardt et al.
5,731,168 A 3/1998 Carter et al.
5,750,373 A 5/1998 Garrard et al.
5,750,692 A 5/1998 Cook et al.
5,770,429 A 6/1998 Lonberg et al.
5,776,688 A 7/1998 Bittner et al.
5,821,337 A 10/1998 Carter et al.
5,869,046 A 2/1999 Presta et al.
5,876,930 A 3/1999 Livak et al.
6,015,886 A 1/2000 Dale et al.
6,028,188 A 2/2000 Arnold et al.
6,075,181 A 6/2000 Kucherlapati et al.
6,124,445 A 9/2000 Imbach et al.
6,147,200 A 11/2000 Manoharan et al.
6,150,584 A 11/2000 Kucherlapati et al.
6,160,109 A 12/2000 Just et al.
6,166,197 A 12/2000 Cook et al.
6,169,170 B1 1/2001 Gryaznov et al.
6,172,209 B1 1/2001 Manoharan et al.
6,194,551 B1 2/2001 Idusogie et al.
6,222,025 B1 4/2001 Cook et al.
6,235,887 B1 5/2001 Froehler et al.
6,239,265 B1 5/2001 Cook
6,248,516 B1 6/2001 Winter et al.
6,268,490 B1 7/2001 Imanishi et al.
6,277,569 B1 8/2001 Bittner et al.
6,277,603 B1 8/2001 Cook
6,326,199 B1 12/2001 Cook et al.
6,346,614 B1 2/2002 Metelev et al.
6,380,368 B1 4/2002 Froehler et al.
6,444,423 B1 9/2002 Meade et al.
6,455,258 B2 9/2002 Bastian et al.
6,528,640 B1 3/2003 Beigelman et al.
6,531,590 B1 3/2003 Manoharan et al.
6,534,639 B1 3/2003 Manoharan et al.
6,602,684 B1 8/2003 Umaña et al.
6,608,035 B1 8/2003 Agrawal et al.
6,617,438 B1 9/2003 Beigelman et al.
6,639,062 B2 10/2003 Manoharan et al.
6,670,461 B1 12/2003 Wengel et al.
6,683,167 B2 1/2004 Metelev et al.
6,737,056 B1 5/2004 Presta
6,794,499 B2 9/2004 Wengel et al.
6,858,715 B2 2/2005 Ravikumar et al.
6,867,294 B1 3/2005 Sanghvi et al.
6,878,805 B2 4/2005 Manoharan et al.
6,982,321 B2 1/2006 Winter
6,998,484 B2 2/2006 Koch et al.
7,015,315 B1 3/2006 Cook et al.
7,041,816 B2 5/2006 Ravikumar et al.
7,041,870 B2 5/2006 Tomizuka et al.
7,045,610 B2 5/2006 Dempcy et al.
7,053,207 B2 5/2006 Wengel
7,084,125 B2 8/2006 Wengel
7,087,409 B2 8/2006 Barbas et al.
RE39,464 E 1/2007 Cook et al.
7,189,826 B2 3/2007 Rodman
7,244,567 B2 7/2007 Chen et al.
7,273,933 B1 9/2007 Krotz et al.
7,321,029 B2 1/2008 Gryaznov et al.
7,332,581 B2 2/2008 Presta
7,371,826 B2 5/2008 Presta
7,399,845 B2 7/2008 Seth et al.
7,427,672 B2 9/2008 Imanishi et al.
7,495,088 B1 2/2009 Brakel et al.
7,521,541 B2 4/2009 Eigenbrot et al.
7,527,791 B2 5/2009 Adams et al.
8,377,921 B2 2/2013 Michellys et al.
9,340,830 B2 5/2016 Lipson et al.
10,000,814 B2 6/2018 Cronin et al.
10,980,804 B2 4/2021 Ali et al.
11,098,368 B2 8/2021 Cronin et al.

(56) References Cited

U.S. PATENT DOCUMENTS

| | | | |
|---|---|---|---|
| 11,230,589 | B2 | 1/2022 | Lipson et al. |
| 11,578,372 | B2 | 2/2023 | Hawryluk et al. |
| 11,771,698 | B2 | 10/2023 | Ali et al. |
| 12,274,699 | B2 | 4/2025 | Ali et al. |
| 12,378,302 | B2 | 8/2025 | Lipson et al. |
| 2002/0164328 | A1 | 11/2002 | Shinkawa et al. |
| 2002/0197679 | A1 | 12/2002 | Tang et al. |
| 2003/0115614 | A1 | 6/2003 | Kanda et al. |
| 2003/0143204 | A1 | 7/2003 | Lewis et al. |
| 2003/0157108 | A1 | 8/2003 | Presta |
| 2003/0166282 | A1 | 9/2003 | Brown et al. |
| 2003/0224432 | A1 | 12/2003 | Myers et al. |
| 2004/0038278 | A1 | 2/2004 | Tzertzinis et al. |
| 2004/0086884 | A1 | 5/2004 | Beach et al. |
| 2004/0093621 | A1 | 5/2004 | Shitara et al. |
| 2004/0109865 | A1 | 6/2004 | Niwa et al. |
| 2004/0110282 | A1 | 6/2004 | Kanda et al. |
| 2004/0110704 | A1 | 6/2004 | Yamane et al. |
| 2004/0132140 | A1 | 7/2004 | Satoh et al. |
| 2005/0014934 | A1 | 1/2005 | Hinton et al. |
| 2005/0079574 | A1 | 4/2005 | Bond |
| 2005/0119455 | A1 | 6/2005 | Fuh et al. |
| 2005/0123546 | A1 | 6/2005 | Umana et al. |
| 2005/0266000 | A1 | 12/2005 | Bond et al. |
| 2005/0287541 | A1 | 12/2005 | Nakagawara et al. |
| 2006/0025576 | A1 | 2/2006 | Miller et al. |
| 2006/0246497 | A1 | 11/2006 | Huang et al. |
| 2006/0275779 | A1 | 12/2006 | Li et al. |
| 2007/0010657 | A1 | 1/2007 | Klocke et al. |
| 2007/0059710 | A1 | 3/2007 | Luke et al. |
| 2007/0061900 | A1 | 3/2007 | Murphy et al. |
| 2007/0087362 | A1 | 4/2007 | Church et al. |
| 2007/0117126 | A1 | 5/2007 | Sidhu et al. |
| 2007/0160598 | A1 | 7/2007 | Dennis et al. |
| 2007/0194225 | A1 | 8/2007 | Zorn |
| 2007/0237764 | A1 | 10/2007 | Birtalan et al. |
| 2007/0248605 | A1 | 10/2007 | Hestir et al. |
| 2007/0292936 | A1 | 12/2007 | Barthelemy et al. |
| 2008/0051462 | A1 | 2/2008 | Fritz et al. |
| 2008/0069820 | A1 | 3/2008 | Fuh et al. |
| 2008/0131375 | A1 | 6/2008 | Gordon et al. |
| 2008/0171689 | A1 | 7/2008 | Williams |
| 2008/0226664 | A1 | 9/2008 | Old et al. |
| 2009/0002360 | A1 | 1/2009 | Chen et al. |
| 2009/0130101 | A1 | 5/2009 | Cohen |
| 2009/0156475 | A1 | 6/2009 | Rikova et al. |
| 2009/0209496 | A1 | 8/2009 | Chaplin et al. |
| 2010/0029498 | A1 | 2/2010 | Gnirke et al. |
| 2011/0118298 | A1 | 5/2011 | Fritz et al. |
| 2011/0150893 | A1 | 6/2011 | Cho et al. |
| 2011/0183924 | A1 | 7/2011 | Mintz et al. |
| 2012/0039805 | A1 | 2/2012 | Lisanti et al. |
| 2012/0208706 | A1 | 8/2012 | Downing et al. |
| 2013/0034559 | A1 | 2/2013 | Queva et al. |
| 2013/0096021 | A1 | 4/2013 | Chinnaiyan et al. |
| 2013/0338079 | A1 | 12/2013 | Tolcher et al. |
| 2014/0336236 | A1 | 11/2014 | Cronin et al. |
| 2015/0073036 | A1 | 3/2015 | Hawryluk et al. |
| 2015/0366866 | A1 | 12/2015 | Ali et al. |
| 2016/0009785 | A1 | 1/2016 | Lipson et al. |
| 2016/0010068 | A1 | 1/2016 | Bastian et al. |
| 2016/0272725 | A1* | 9/2016 | Stransky .......... G01N 33/57484 |
| 2018/0030548 | A1 | 2/2018 | Nanda et al. |
| 2018/0045727 | A1 | 2/2018 | Spetzler et al. |
| 2018/0179578 | A1 | 6/2018 | Raymond et al. |
| 2018/0346992 | A1 | 12/2018 | Cronin et al. |
| 2019/0136301 | A1 | 5/2019 | Lipson et al. |
| 2019/0367613 | A1 | 12/2019 | Harvey et al. |
| 2020/0299774 | A1 | 9/2020 | Basu et al. |
| 2020/0299775 | A1 | 9/2020 | Hawryluk et al. |
| 2021/0283134 | A1 | 9/2021 | Ali et al. |
| 2022/0002818 | A1 | 1/2022 | Cronin et al. |
| 2022/0169703 | A1 | 6/2022 | Lipson et al. |
| 2023/0372338 | A1 | 11/2023 | Ali et al. |
| 2024/0093304 | A1 | 3/2024 | Erbach et al. |
| 2024/0360199 | A1 | 10/2024 | Lipson et al. |
| 2025/0129429 | A1 | 4/2025 | Madison et al. |
| 2025/0146076 | A1 | 5/2025 | Liu et al. |
| 2025/0195514 | A1 | 6/2025 | Siraj et al. |

FOREIGN PATENT DOCUMENTS

| | | | |
|---|---|---|---|
| EP | 171496 | A2 | 2/1986 |
| EP | 173494 | A2 | 3/1986 |
| EP | 184187 | A2 | 6/1986 |
| EP | 264166 | A1 | 4/1988 |
| EP | 404097 | A2 | 12/1990 |
| EP | 125023 | B1 | 6/1991 |
| EP | 430402 | A2 | 6/1991 |
| EP | 698096 | B1 | 2/1996 |
| EP | 2057465 | A2 | 5/2009 |
| EP | 2877854 | B1 | 9/2022 |
| WO | WO-1986001533 | A1 | 3/1986 |
| WO | WO-1987002671 | A1 | 10/1987 |
| WO | WO-1988009810 | A1 | 12/1988 |
| WO | WO-1989010134 | A1 | 11/1989 |
| WO | WO-1990002809 | A1 | 3/1990 |
| WO | WO-1992001047 | A1 | 7/1991 |
| WO | WO-1991017271 | A1 | 11/1991 |
| WO | WO-1992009690 | A2 | 6/1992 |
| WO | WO-1992015679 | A1 | 9/1992 |
| WO | WO-1992018619 | A1 | 10/1992 |
| WO | WO-1992020791 | A1 | 11/1992 |
| WO | WO-1993001161 | A1 | 1/1993 |
| WO | WO-1993001288 | A1 | 1/1993 |
| WO | WO-1993008829 | A1 | 5/1993 |
| WO | WO-1993016185 | A2 | 8/1993 |
| WO | WO-1994016101 | A2 | 7/1994 |
| WO | WO-1994021822 | A1 | 9/1994 |
| WO | WO-1994026889 | A2 | 11/1994 |
| WO | WO-1994029351 | A2 | 12/1994 |
| WO | WO-1996029431 | A2 | 9/1996 |
| WO | WO-1997030087 | A1 | 8/1997 |
| WO | WO-1998058964 | A1 | 12/1998 |
| WO | WO-1999022764 | A1 | 5/1999 |
| WO | WO-1999051642 | A1 | 10/1999 |
| WO | WO-2000061739 | A1 | 10/2000 |
| WO | WO-2001027081 | A1 | 4/2001 |
| WO | WO-2001029246 | A1 | 4/2001 |
| WO | WO-2002031140 | A1 | 4/2002 |
| WO | WO-2003011878 | A2 | 2/2003 |
| WO | WO-2003031568 | A2 | 4/2003 |
| WO | WO-2003084570 | A1 | 10/2003 |
| WO | WO-2003085107 | A1 | 10/2003 |
| WO | WO-2003085119 | A1 | 10/2003 |
| WO | WO-2004013099 | A1 | 2/2004 |
| WO | WO-2004056312 | A2 | 7/2004 |
| WO | WO-2005016894 | A1 | 2/2005 |
| WO | WO-2005035586 | A1 | 4/2005 |
| WO | WO-2005035778 | A1 | 4/2005 |
| WO | WO-2005053742 | A1 | 6/2005 |
| WO | WO-2005100402 | A1 | 10/2005 |
| WO | WO-2006000121 | A1 | 1/2006 |
| WO | WO-2006029879 | A2 | 3/2006 |
| WO | WO-2006121168 | A1 | 11/2006 |
| WO | WO-2007005874 | A2 | 1/2007 |
| WO | WO-2007060402 | A1 | 5/2007 |
| WO | WO-2008021290 | A2 | 2/2008 |
| WO | WO-2008077546 | A1 | 7/2008 |
| WO | WO-2009089004 | A1 | 7/2009 |
| WO | WO-2009101611 | A1 | 8/2009 |
| WO | WO-2009114335 | A2 | 9/2009 |
| WO | WO-2010027827 | A2 | 3/2010 |
| WO | WO-2010077634 | A1 | 7/2010 |
| WO | WO-2010081817 | A1 | 7/2010 |
| WO | WO-2011005861 | A1 | 1/2011 |
| WO | WO-2011066342 | A2 | 6/2011 |
| WO | WO-2011066389 | A1 | 6/2011 |
| WO | WO-2011135376 | A1 | 11/2011 |
| WO | WO-2012092426 | A1 | 7/2012 |
| WO | WO-2013059740 | A1 | 4/2013 |
| WO | WO-2013076186 | A1 | 5/2013 |
| WO | WO-2013087716 | A2 | 6/2013 |
| WO | WO-2013133351 | A1 | 9/2013 |

(56) References Cited

FOREIGN PATENT DOCUMENTS

| | | | |
|---|---|---|---|
| WO | WO-2014018673 | A2 | 1/2014 |
| WO | WO-2014036387 | A2 | 3/2014 |
| WO | WO-2014051022 | A1 | 4/2014 |
| WO | WO-2014071358 | A2 | 5/2014 |
| WO | WO-2014071419 | A2 | 5/2014 |
| WO | WO-2014113729 | A2 | 7/2014 |
| WO | WO-2014130975 | A1 | 8/2014 |
| WO | WO-2015016718 | A1 | 2/2015 |
| WO | WO-2016028316 | A1 | 2/2016 |
| WO | WO-2016196671 | A1 | 12/2016 |
| WO | WO-2019158512 | A1 | 8/2019 |
| WO | WO-2020243021 | A2 | 12/2020 |
| WO | WO-2022147163 | A1 | 7/2022 |

OTHER PUBLICATIONS

Dermawan et al., (2021). "Superficial ALK-rearranged myxoid spindle cell neoplasm: a cutaneous soft tissue tumor with distinctive morphology and immunophenotypic profile," Modern Pathology, 34(9):1710-8.

Extended European Search Report received for European Patent Application No. 20813286.0 mailed on Sep. 20, 2023, 15 pages.

Majewski et al., (2013). "Identification of recurrent FGFR3 fusion genes in lung cancer through kinome-centred RNA sequencing," J. Pathol., 230(3):270-276.

Parker et al., (2013). "The tumorigenic FGFR3-TACC3 gene fusion escapes miR-99a regulation in glioblastoma," J Clin Invest., 123(2):855-865.

Partial Supplementary European Search Report and Written Opinion received for European Patent Application No. 20813286.0 mailed on Jun. 19, 2023, 17 pages.

Salant et al., (2003). "Role of nephrin in proteinuric renal diseases," Springer Semin Immunopathol, 24:423-439.

Shaw et al., (2013). "Tyrosine kinase gene rearrangements in epithelial malignancies," Nature Reviews Cancer, 13(11):772-787, 33 pages.

Tian et al., (2022). "A novel alectinib-sensitive CTNND1-ALK fusion in a lung adenocarcinoma patient: a case report," Investigational New Drugs, 40(4):850-3. Abstract Only.

Albanese, C. et al., "Dual targeting of CDK and tropomyosin receptor kinase families by the oral inhibitor PHA-848125, an agent with broad-spectrum antitumor efficacy", Mol Cancer Ther 9(8):2243-54, Aug. 3, 2010.

Altorki et al. "Phase II Proof-of-Concept Study of Pazopanib Monotherapy in Treatment-Naive Patience With State I/II Resectable Non-Small-Cell Lung Cancer" Journal of Clinical Oncology (2010) vol. 28, No. 19, pp. 3131-3137.

Amatu et al. "NTRK gene fusions as novel targets of cancer therapy across multiple tumour types" ESMO Open (2016) vol. 1, e000023, pp. 1-9.

Ardini et al., (2014). "The TPM3-NTRK1 rearrangement is a recurring event in colorectal carcinoma and is associated with tumor sensitivity to TRKA kinase inhibition," Mol Oncol., 8:1495-507.

Avet-Loiseau et al. "High Incidence of Translocations t(11;14)(q13;q32) and t(4;14)(p16;q32) in Patients with Plasma Cell Malignancies" Cancer Research (1998) vol. 58, pp. 5640-5645.

Bai et al. "GP369, an FGFR2-IIIb-Specific Antibody, Exhibits Potent antitumor Activity against Human Cancers Driven by Activated FGFR2 Signaling" Cancer Research (2010), 70(19):7630-39.

Bender et al., (2019). "Refractory and metastatic infantile fibrosarcoma harboring LMNA-NTRK1 fusion shows complete and durable response to crizotinib," Cold Spring Harb Mol Case Stud., 5:a00376, 9 pages.

Brambilla et al., "The new World Health Organization classification of lung tumours," Eur Respir J (2001) vol. 18, pp. 1059-1068.

Brave et al. "Assessing the Activity of Cediranib, a VEGFR-2/3 Tyrosine Kinase Inhibitor, against VEGFR-1 and Members of the Structurally Related PDGFR Family" Molecular Cancer Therapeutics (2011) vol. 10 No 5 pp. 861-873.

Byron et al. "Inhibition of Activated Fibroblast Growth Factor Receptor 2 in Endometrial Cancer Cells Induces Cell Death Despite PTEN Abrogation" Cancer Research (2008), 68(17):6902-10005.

Camidge et al. "Optimizing the detection of lung cancer patients harboring anaplastic lymphoma kinase (ALK) gene rearrangements potentially suitable for ALK inhibitor treatment." Clin Cancer Res Nov. 14, 2010 vol. 16 No. 22 pp. 5581-5590. Especially p. 5586 col. 2 para 2-3.

Caneiro et al. "FGFR3-TACC3: A novel gene fusion in cervical cancer" Gynecologic Oncology Reports (2015), vol. 13, pp. 53-56.

Capelletti et al. "Identification of Recurrent FGFR3-TACC3 Fusion Oncogenes from Lung Adenocarcinoma" Clin Cancer Res (2014) vol. 20, pp. 6551-6558.

Cappellen et al., "Frequent activating mutations of FGFR3 in human bladder and cervix carcinomas," Nature Genetics (1999) vol. 23, pp. 18-20.

Chen et al. "FGFR3 as a therapeutic target of the small molecule inhibitor PKC412 in hematopoietic malignancies" Oncogene (2005) vol. 24, pp. 8259-8267.

Chiorean et al, "M887: Imatinib Mesylate (STI-571), a c-Abl Kinase Inhibitor, Indirectly Blocks Receptor Tyrosine Kinase Activation and Induces Apoptosis in a Human Cholangiocarcinoma Cell Line" Gastroenterology (2003), 124(4):A-742, 1 page.

Cho et al. "Enhanced Expression of Keratinocyte Growth Factor and Its Receptor Correlates with Venous Invasion in Pancreatic Cancer" The American Journal of Pathology (2007), 170(6):1964-74.

ClinicalTrials.Gov Identifier No. NCT02568267, "Basket Study of Entrectinib (RXDX-101) for the Treatment of Patients With Solid Tumors Harboring NTRK 1/2/3/ (Trk A/B/C), ROS1, or ALK Gene Rearrangements (Fusions) (STARTRK-2)" Last Updated: Jan. 3, 2017; https://clinicaltrials.gov/ct2/show/NCT02568267?term=NTRK1+fusion+lung&rank=1; Retrieved Jan. 4, 2017, 5 pages.

ClinicalTrials.Gov Identifier No. NCT0257643.1, "Study of LOXO-101 in Subjects With NTRK Fusion Positive Solid Tumors (NAVIGATE)" Last Updated: Nov. 16, 2016; https://clinicaltrials.gov/ct2/show/NCT02576431?term=NTRK1+fusion+lung&rank=2; Retrieved Jan. 4, 2017, 4 pages.

Cocco et al., (2018). "NTRK fusion-positive cancers and TRK inhibitor therapy," Nat Rev Clin Oncol., 15:731-747, 34 pages.

Cohen, Roger B. et al., "A phase I dose-escalation study of danusertib (PHA-739358) administered as a 24-hour infusion with and without granulocyte colony-stimulating factor in a 14-day cycle in patients with advanced solid tumors", Clin Cancer Res 15(21):6694-701, ePub Oct. 13, 2009, Nov. 1, 2009.

Cole et al. "Inhibition of FGFR2 and FGFR1 increases cisplatin sensitivity in ovarian cancer" Cancer Biology & Therapy (2010) vol. 10 No. 5 pp. 495-504.

Cortes et al. "A Pivotal PhaM 2 Trial of Ponatinib in Patients with Chronic Myeloid Leukemia (CML) and Philadelphia Chromosome-Positive Acute Lymphoblastic Leukemia (Ph+ALL) ReslilttIInt or Intole111nt to Dasatinib or Nilotinib, or with the T3151 BCR-ABL Mutation: 1Z-Month Follow-up of the PACE Trial" ASH Annual Meeting and Exposition (Dec. 9, 2012) Abstract No. 163, 2 pages.

Costa et al. "FGFR3-TACC3 fusion in solid tumors: mini review" Oncotarget (2016) vol. 7, No. 34, pp. 55924-55938.

Daugrois et al., (2021). "Gene Expression Signature Associated with Clinical Outcome in ALK-Positive Anaplastic Large Cell Lymphoma," Cancers, 13(21):5523.

Degrassi, A. et al., "Efficacy of PHA-848125, a cyclin-dependent kinase inhibitor, on the K-Ras(G12D) LA2 lung adenocarcinoma transgenic mouse model: evaluation by multimodality imaging", Mol Cancer Ther 9(3):673-81, Mar. 9, 2010.

Deinhardt et al., (2014). "Trk receptors," Handb Exp Pharmacol., 220:103-19.

Dhami et al., "Comprehensive genomic profiling aids in treatment of metastatic endometrial cancer," Cold Spring Harb Mol Case Stud (2018) vol. 4, Article a002089, 14 pages.

Di Martino et al., (2012). "A Decade of FGF Receptor Research in Bladder Cancer: Past, Present, and Future Challenges," Adv Urol, 2012:429213, 10 pages.

(56) References Cited

OTHER PUBLICATIONS

Doebele et al. "An Oncogenic NTRK Fusion in a Patient with Soft-Tissue Sarcoma with Response to the Tropomyosin-Related Kinase Inhibitor LOXO-101" Cancer Discovery (2015) vol. 5, pp. 1049-1057.
Doebele et al., "NTRK1 Gene Fusions as a Novel Oncogene Target in Lung Cancer", 2013 ASCO Annual Meeting; Abstract No. 8023; Abstract only (May 31-Jun. 4, 2013), 2 pages.
Doebele et al., "NTRK1 Gene Fusions as a Novel Oncogene Target in Lung Cancer", 2013 ASCO Annual Meeting; Abstract No. 8023; Poster (May 31-Jun. 4, 2013), 1 page.
Eswarakumar et al., (2005). "Cellular signaling by fibroblast growth factor receptors," Cytokine Growth Factor Rev, 16(2):139-49. Abstract Only.
Extended European Search Report received for European Patent Application No. 21179077.9 mailed on Dec. 10, 2021, 7 pages.
Fang et al., (2016). "Detection of a novel RET gene fusion in a non-small cell lung cancer patient using AMP chemistry," J Thoracic Oncol., 11:S21-S22.
Fang et al., (2019). "MPRIP-ALK, a Novel ALK Rearrangement That Responds to ALK Inhibition in NSCLC," J Thorac Oncol., 14:e148-e151.
Farago et al., "Durable Clinical Response to Entrectinib in NTRK1-Rearranged Non-Small Cell Lung Cancer" Journal of Thoracic Oncology (2015) vol. 10, No. 12, pp. 1670-1674.
Fu et al., (2011). "Novel functions of endocytic player clathrin in mitosis," Cell research, 21:1655-1661.
Gainor et al., (2013). "Novel targets in non-small cell lung cancer: ROS1 and RET fusions," Oncologist, 18:865-75.
Garcia-Mayoral et al. "The Structure of the C-Terminal KH Domains of KSRP Reveals a Noncanonical Motif Important for mRNA Degradation" Structure (2007) vol. 15 pp. 485-498.
Gartside et al. "Loss-of-Function Fibroblast Growth Factor Receptor-2 Mutations in Melanoma" Molecular Cancer Research (2009) vol. 7 No. 1 pp. 41-54.
GenBank Accession No. NM_000141 accessed Nov. 19, 2015 from <http://www.ncbi.nlm.nih.gov/nuccore/189083823>, 8 pages.
GenBank Accession No. NM_001012331 accessed Nov. 19, 2015 from <http://www.ncbi.nlm.nih.gov/nuccore/NM_001012331.1>, 6 pages.
Genbank Accession No. NM_001080512 accessed Nov. 19, 2015 from <http://www.ncbi.nlm.nih.gov/nuccore/NM_001080512.2>, 6 pages.
GenBank Accession No. NM_001127211 accessed Nov. 19, 2015 from <http://www.ncbi.nlm.nih.gov/nuccore/385198090>, 6 pages.
GenBank Accession No. NM_001144915 accessed on Nov. 17, 2015 from <http://www.ncbi.nlm.nih.gov/nuccore/NM_001144915.1>, 6 pages.
GenBank Accession No. NM_003787 accessed Nov. 19, 2015 from <http://www.ncbi.nlm.nih.gov/nuccore/NM_003787>, 4 pages.
GenBank Accession No. NM_004562 accessed Nov. 19, 2015 from <http://www.ncbi.nlm.nih.gov/nuccore/NM_004562.2>, 5 pages.
GenBank Accession No. NM_006342 accessed Nov. 19, 2015 from <http://www.ncbi.nlm.nih.gov/nuccore/NM_006342>, 6 pages.
GenBank Accession No. NM_022494 accessed Nov. 19, 2015 from <http://www.ncbi.nlm.nih.gov/nuccore/NM_022494.2>, 3 pages.
GenBank Accession No. NP_001012331 accessed Nov. 19, 2015 from <http://www.ncbi.nlm.nih.gov/protein/59889558>, 5 pages.
Gergely et al. "The TACC domain identifies a family of centrosomal proteins that can interact with microtubules" Proc Natl Acad Sci. (2000) vol. 97, pp. 14352-14357.
Giamas et al., (2007). "Protein kinases as targets for cancer treatment," Pharmacogenomics, 8(8); 1005-1016.
Gosenca et al., (2014). "Identification and functional characterization of imatinib-sensitive DTD1-PDGFRB and CCDC88C-PDGFRB fusion genes in eosinophilia-associated myeloid/lymphoid neoplasms," Genes Chromosomes Cancer, 53:411-21.
Gozgit et al "Ponatinib (AP24534), a Multitargeted Pan-FGFR Inhibitor with Activity in Multiple FGFR-Amplified or Mutated Cancer Models" Molecular Cancer Therapeutics (2012) vol. 11 No 3 pp. 690-699.
Greco A, et al. "Characterization of the NTRK1 genomic region involved in chromosomal rearrangements generating TRK oncogenes." Genomics (1993) 18(2):397-400.
Greco A, et al. "TRK-T1 is a novel oncogene formed by the fusion of TPR and TRK genes in human papillary thyroid carcinomas." Oncogene (1992) 7(2):237-42.
Greco et al. Rearrangements of NTRK1 gene in papillary thyroid carcinoma. Mol Cell Endrocrinol May 28, 2010 vol. 321 No. 1 pp. 44-49. Especially p. 46 col. 2 para 3.
Greco et al., (1998). "Role of the TFG N-terminus and coiled-coil domain in the transforming activity of the thyroid TRK-T3 oncogene," Oncogene, 16:809-16.
Greco, A. et al., "The DNA rearrangement that generates the TRK-T3 oncogene involves a novel gene on chromosome 3 whose product has a potential coiled-coil domain", Mol Cell Biol 15(11):6118-27, Nov. 1995.
Griono et al., (2019). "A Simple RNA Target Capture NGS Strategy for Fusion Genes Assessment in the Diagnostics of Pediatric B-cell Acute Lymphoblastic Leukemia," Hemasphere, 3:e250, 9 pages.
Guagnano et al., "FGFR Genetic Alterations Predict for Sensitivity to NVP-BGJ398, a Selective Pan-FGFR Inhibitor," Cancer Discovery (2012) vol. 2, pp. 1118-1133.
Han, Sy et al., "Evaluation of a multi-kinase inhibitor KRC-108 as an anti-tumor agent in vitro and in vivo", Invest New Drugs 30(2):518-23, ePub Nov. 16, 2010, Apr. 2012.
Hirai et al., (2020). "Large-scale metabarcoding analysis of epipelagic and mesopelagic copepods in the Pacific," PLOS One, 15:e0233189, 24 pages.
Huehne K, et al. "Novel missense, insertion and deletion mutations in the neurotrophic tyrosine kinase receptor type 1 gene (NTRK1) associated with congenital insensitivity to pain with anhidrosis." Neuromuscul Disord (2008) 18(2):159-66.
Huether et al.: "Sorafenib alone or as combination therapy for growth control of cholangiocarcinoma", Biochemical Pharmacology, Elsevier, US, vol. 73, No. 9, Mar. 24, 2007 (Mar. 24, 2007), pp. 1308-1317. Abstract Only.
Hyman et al. "The efficacy of larotrectinib (LOXO-101), a selective tropomyosin receptor kinase (TRK) inhibitor, in adult and pediatric TRK fusion cancers" Presentation from the ASCO Annual Meeting 2017, 1-24 pages.
Indo Y, et al. "Structure and organization of the human TRKA gene encoding a high affinity receptor for nerve growth factor." Jpn J Hum Genet (1997) 42(2):343-51.
International Preliminary Report on Patentability and Written Opinion for International Application No. PCT/US2012/061211 issued Apr. 22, 2014, 8 pages.
International Preliminary Report on Patentability for International Application No. PCT/US2013/068604 dated May 5, 2015, 9 pages.
International Preliminary Report on Patentability from PCT/US2014/012136 mailed Mar. 18, 2015, 18 pages.
International Search Report and Written Opinion for International Application No. PCT/US2013/068457 dated Jul. 11, 2014, 15 pages.
International Search Report and Written Opinion for International Application No. PCT/US2013/068604 mailed Nov. 7, 2014, 16 pages.
International Search Report and Written Opinion for PCT/US2014/012136 mailed Jul. 16, 2014, 20 pages.
International Search Report for International Application No. PCT/US2012/061211 mailed Feb. 5, 2013, 4 pages.
International Search Report for International Application No. PCT/US2020/034421 mailed Dec. 11, 2020, 12 pages.
International Search Report for International Application No. PCT/US2021/65561 mailed Jun. 7, 2022, 13 pages.
Iyer, R. et al., "Lestaurtinib enhances the antitumor efficacy of chemotherapy in murine xenograft models of neuroblastoma", Clin Cancer Res 16(5):1478-85, ePub Feb. 23, 2010, Mar. 1, 2010.
Javle et al., "Biliary Cancer: Utility of Next-Generation Sequencing for Clinical Management," Cancer (2016) vol. 122, pp. 3838-3847.

(56) References Cited

OTHER PUBLICATIONS

Jiao et al., "Exome sequencing identifies frequent inactivating mutations in BAP1, ARID1A and PBRM in intrahepatic cholangiocarcinomas," Nature Genetics (2013) vol. 45, No. 12, pp. 1470-1473 and Supplementary Information.
Kang et al., "microRNA-99b acts as a tumor suppressor in non-small cell lung cancer by directly targeting fibroblast growth factor receptor 3," Experimental and Therapeutic Medicine (2012) vol. 3, pp. 149-153.
Keats et al. "In multiple myeloma, t(4;14)(p16;q32) is an adverse prognostic factor irrespective of FGFR3 expression" Blood (2003) vol. 101, No. 4, pp. 1520-1529.
Keegan et al. "Isolation of an additional member of the fibroblast growth factor receptor family, FGFR-3" Proc Natl Acad Sci. (1991) vol. 88, No. 4, pp. 1095-1099.
Kelleher et al. The emerging pathogenic and therapeutic importance of the anaplastic lymphoma kinase gene. Eur J Cancer Sep. 2010 vol. 46 No. 13 pp. 2357-2368. Especially p. 2365 table 6.
Kheder et al., (2018). "Emerging Targeted Therapy for Tumors with NTRK Fusion Proteins," Clin. Cancer Res, 24(23):5807-5814.
Ko et al. "Phase II study of telatinib (T) in combination with capecitabine (X) and cisplatin (P) as first-line treatment in patients (pts) with advanced cancer of the stomach (G) or gastro-esophageal junction (GEJ)." Journal of Clinical Oncology ASCO Annual Meeting Abstracts, vol. 28 No. 15; May 20 supplement (2010), 1 page.
Lam et al., "Expression profiling in lung adenocarcinomas with or without epidermal growth factor receptor (EGFR) gene mutation at exons 18-21 reveals expression signatures related to the EGFR pathway," Proc Amer Assoc Cancer Res (2005) vol. 46, Abstract 883.
Landis et al "Cancer Statistics, 1998" Ca Cancer J Clin (1998) vol. 48 No. 1 pp. 6-29.
Lee et al., "The potential role of comprehensive genomic profiling to guide targeted therapy for patients with biliary cancer," Ther Adv Gastroenterol (2017) vol. 10, No. 6, pp. 507-520.
Lih et al. "N of 2 Responders With LMNA-NTRK1" J Natl Cancer Inst (2016) vol. 108, No. 1, djv376, pp. 1-2.
Lin et al., "Exon Array Profiling Detects EML4-ALK Fusion in Breast, Colorectal, and Non-Small Cell Lung Cancers" Mol Cancer Research (2009) vol. 7, No. 9, pp. 1466-1476.
Lorenzi et al. "FRAG1, a gene that potently activates fibroblast growth factor receptor by C-terminal fusion through chromosomal rearrangement" Proc. Natl. Acad. Sci. USA (1996) vol. 93 pp. 8956-8961.
Lorenzi et al. "Ligand-independent activation of fibroblast growth factor receptor-2 by carboxl terminal alterations" Oncogene (1997) vol. 15 pp. 817-826.
Marchetti et al., "Frequent Mutations in the Neurotrophic Tyrosine Receptor Kinase Gene Family in Large Cell Neuroendocrine Carcinoma of the Lung" Human Mutation (2008) vol. 29, No. 5, pp. 609-616.
Mardy et al., Congenital insensitivity to pain with anhidrosis: Novel mutations in the TRKA (NTRK1) gene encoding a high-affinity receptor for nerve growth factor, 1999, Am. J. Hum. Genet., 64, pp. 1570-1579.
Martin-Zanca D, et al. "A human oncogene formed by the fusion of truncated tropomyosin and protein tyrosine kinase sequences." Nature (1986) 319(6056):743-8.
Matsumoto et al. "FGFR2 gene amplification and clinicopathological features in gastric cancer" British Journal of Cancer (2012) vol. 106 No. 4 pp. 727-732.
McKay et al. "PP58 Novel potential therapeutic targets for cholangiocarcinoma identified by array comparative hybridization" European Journal of Cancer (2009) vol. 7 No. 4, 1 page.
Meulenbeld, Hielke J. et al., "Danusertib, an aurora kinase inhibitor," Expert Opinion Investigative Drugs. Mar. 2012, 21(3), pp. 383-393. Abstract Only.
Miki et al., (1992). "Determination of ligand-binding specificity by alternative splicing: two distinct growth factor receptors encoded by a single gene," PNAS USA, 89(1):246-250.
Miura Y, et al. "Mutation and polymorphism analysis of the TRKA (NTRK1) gene encoding a high-affinity receptor for nerve growth factor in congenital insensitivity to pain with anhidrosis (CIPA) families." Hum Genet (2000) 106(1):116-24.
Monk et al. "Phase II, Open-Label Study of Pazopanib or Lapatinib Monotherapy Compared With Pazopanib Plus Lapatinib Combination Therapy in Patients With Advanced and Recurrent Cervical Cancer" Journal of Clinical Oncology (2010) vol. 28, No. 22, pp. 3562-3569.
Muller-Tidow et al., Identification of Metastasis-Associated Receptor Tyrosine Kinases in Non-Small Cell Lung Cancer, 2005, Cancer Res., vol. 65, No. 5 pp. 1778-1782.
Narong et al., "Basic fibroblast growth factor induces cholangiocarcinoma cell migration via activation of the MEK1/2 pathway" Oncology Letters (2011) pp. 821-825.
Naumann et al., (2015). "Fusion of PDGFRB to MPRIP, CPSF6, and GOLGB1 in three patients with eosinophilia-associated myeloproliferative neoplasms," Genes Chromosomes Cancer, 54:762-70.
Notification of Transmittal of the International Search Report and Written Opinion of the International Searching Authority from corresponding PCT/US2013/068457 dated Jul. 11, 2014, 1 page.
Notification of Transmittal of the International Search Report and Written Opinion of the International Searching Authority from corresponding PCT/US2013/068604 dated Jul. 11, 2014, 1 page.
Ou et al., "Emergence of FGFR3-TACC3 fusions as a potential by-pass resistance mechanism to EGFR tyrosine kinase inhibitors in EGFR mutated NSCLC patients," Lung Cancer (2017) vol. 111, pp. 61-67.
Patel et al "Cholangiocarcinoma—controversies and challenges" Nat Rev Gastroenterol Hepatol (2011), 8(4):189-200, 25 pages.
Patel et al. "Worldwide trends in mortality from biliary tract malignancies" BMC Cancer (2002), 2(10):1-5.
Perez-Pinera P, et al. "The Trk tyrosine kinase inhibitor K252a regulates growth of lung adenocarcinomas." Mol Cell Biochem (2007) 295(1-2):19-26.
Peset et al., (2008). "The TACC proteins: TACC-ling microtubule dynamics and centrosome function," Trends in cell biology, 18.8: 379-388.
Powers et al. "Fibroblast growth factors, their receptors and signaling" Endocrine-Related Cancer (2000) vol. 7 pp. 165-197.
PubChem, (2012). "Ceritinib, CID=57379345," Available online at <https://pubchem.ncbi.nlm.nih.gov/compound/Ceritinib>, 50 pages.
Rao, R. et al., "Heat shock protein 90 inhibition depletes TrkA levels and signaling in human acute leukemia cells", Mol Cancer Ther 9(8):2232-42, ePub Jul. 27, 2010, Aug. 2010.
Reck et al. "A phase II double-blind study to investigate efficacy and safety of two doses of the triple angiokinase inhibitor BIBF 1120 in patients with relapsed advanced non- small-cell lung cancer" Annals of Oncology (2011) vol. 22, pp. 1374-1381.
Richelda et al. "A Novel Chromosomal Translocation t(4; 14) (p16.3; q32) in Multiple Myeloma Involves the Fibroblast Growth Factor Receptor 3 Gene" Blood (1997) vol. 90, No. 10, pp. 4062-4070.
Royle, (2011). "Mitotic moonlighting functions for membrane trafficking proteins," Traffic, 12:791-798.
Santra et al. "A subset of multiple myeloma harboring the t(4;14)(p16;q32) translocation lacks FGFR3 expression but maintains an IGH/MMSET fusion transcript" Blood (2003) vol. 101, No. 6, pp. 2374-2376.
Sartore-Bianchi et al. "Sensitivity to Entrectinib Associated With a Novel LMNA-NTRK1 Gene Fusion in Metastatic Colorectal Cancer" J Natl Cancer Inst (2016) vol. 108, No. 1, djv306, pp. 1-4.
Schneider et al., "The transforming acidic coiled coil 3 protein is essential for spindle-dependent chromosome alignment and mitotic survival" The Journal of Biological Chemistry, 282(40):29273-29283 (2007).
Shu et al., (2020). "Identification of a Novel MPRIP-ROS1 Fusion and Clinical Efficacy of Crizotinib in an Advanced Lung Adenocarcinoma Patient: A Case Report," Onco Targets Ther., 13:10387-10391.

(56) References Cited

OTHER PUBLICATIONS

Singh et al "Transforming Fusions of FGFR and TACC Genes in Human Glioblastoma" Science (2012) vol. 337(6099) pp. 1231-1235.
Stewart et al. "Correlation of TACC3, FGFR3, MMSET and p21 expression with the t(4;14)(p16.3;q32) in multiple myeloma" British Journal of Haematology (2004) vol. 126, pp. 72-76.
Sundem, "NTRK1: A new oncogene and target in lung cancer". University of Colorado Denver, Public release date: Jun. 3, 2013, 2 pages.
Tacconelli, A. et al., "TrkA alternative splicing: a regulated tumor-promoting switch in human neuroblastoma", Cancer Cell 6(4):347-60, Oct. 2004.
Takeuchi et al. Multiplex reverse transcription-PCR screening for EML4-ALK fusion transcripts. Clin Cancer Res Oct. 15, 2008 vol. 14 No. 20 pp. 6618-6624.
Teixeira et al., "Recurrent Fusion Oncogenes in Carcinomas" Critical Reviews in Oncogenesis, 12(3-4):257-271 (2006).
Thress, K. et al., "Identification and preclinical characterization of AZ-23, a novel, selective, and orally bioavailable inhibitor of the Trk kinase pathway", Mol Cancer Ther 8(7):1818-27, ePub Jun. 9, 2009, Jul. 2009.
Toyokawa et al. "Co-expression of keratinocyte growth factor and K-sam is an independent prognostic factor in gastric carcinoma" Oncology Reports (2009) vol. 21 pp. 875-880.
Turner et al "Fibroblast growth factor signalling: from development to cancer" Nature (2010) vol. 10, pp. 116-129.
Turner et al. "Integrative molecular profiling of triple negative breast cancers identifies amplicon drivers and potential therapeutic targets" Oncogene (2010) vol. 8 No. 29 pp. 2013-2023, 20 pages.
Tuysuz et al., (2008). "Novel NTRK1 mutations cause hereditary sensory and autonomic neuropathy type IV: demonstration of a founder mutation in the Turkish population," Neurogenetics, 9:119-125.
Undevia, SD et al., "Phase I clinical trial of CEP-2563 dihydrochloride, a receptor tyrosine kinase inhibitor, in patients with refractory solid tumors", Invest New Drugs 22(4):449-58, Nov. 2004.
Vaishnavi, Aria et al., "Oncogenic and drug-sensitive NTRK1 rearrangements in lung cancer", Nature Medicine, vol. 19, No. 11, pp. 1469-1472, ePub Oct. 27, 2013, Nov. 2013.
Vendrell et al., (2017). "Detection of known and novel ALK fusion transcripts in lung cancer patients using next-generation sequencing approaches," Sci. Rep., 7(12510):1-11.
Wang et al."Mutations in Isocitrate Dehydrogenase 1 and 2 Occur Frequently in Intrahepatic Cholangiocarcinomas and Share Hypermethylation Targets with Glioblastomas" Oncogene (2013), 23(25):1-22.
Wang et al. Fusion of dynactin 1 to anaplastic lymphoma kinase in inflammatory myofibroblastic tumor. Hum Pathol ePub Jun. 1, 2012 vol. 43 No. 11 pp. 2047-2052.
Ware et al. "Rapidly Acquired Resistance to EGFR Tyrosine Kinase Inhibitors in NSCLC Cell Lines through De-Repression of FGFR2 and FGFR3 Expression" PLOS One (2010) vol. 5, No. 11, pp. e14117.
Weiss, GJ et al., "Phase I study of the safety, tolerability and pharmacokinetics of PHA-848125AC, a dual tropomyosin receptor kinase A and cyclin-dependent kinase inhibitor, in patients with advanced solid malignancies", Invest New Drugs, 30(6):2334-2343 ePub Dec. 2011, Dec. 2012, 19 pages.
Werner et al., (2020). "Genomics based personalized oncology of cancer of unknown primary," Cancer Research, 80(16), 1 page.
Wessley et al., (2001). "Gene Expression Pattern: Identification and expression of the mammalian homologue of Bicaudal-C," Mech. Dev. 101, 267-270.
Wiesner et al., "Kinase fusions are frequent in Spitz tumours and spitzoid melanomas," Nature Communications (2014) vol. 5, Article 3116, 9 pages.
Williams et al., "Oncogenic FGFR3 gene fusions in bladder cancer" Human Molecular Genetics, 22(4):795-803 (2013).
Woenckhaus et al., "Prognostic value of FHIT, CTNNB1, and MUC1 expression in non-small cell lung cancer," Human Pathology (2008) vol. 39, pp. 126-136.
Wong et al. "Evaluation of a Congenital Infantile Fibrosarcoma by Comprehensive Genomic Profiling Reveals an LMNA NTRK1 Gene Fusion Responsive to Crizotinib" J Natl Cancer Inst (2016) vol. 108, No. 1, pp. 1-3.
Wu et al. "Identification of Targetable FGFR Gene Fusions in Diverse Cancers" Cancer Discovery (Jun. 2013) pp. 636-647.
Yoon et al. "Enhanced epidermal growth factor receptor activation in human cholangiocarcinoma cells" Journal of Hepatology (2004) pp. 808-814.
Zhang et al., (2010). "Fusion of EML4 and ALK is associated with development of lung adenocarcinomas lacking EGFR and KRAS mutations and is correlated with ALK expression," Mol Cancer, 9:188, 12 pages.
Adnane et al., (1991). "BEK and FLG, two receptors to members of the FGF family, are amplified in subsets of human breast cancers," Oncogene, 6(4):659-63.
Akslen et al., (2005). "BRAF and NRAS mutations are frequent in nodular melanoma but are not associated with tumor cell proliferation or patient survival," J Invest Dermatol, 125(2):312-7.
Al-Ahmadie et al., (2011). "Somatic mutation of fibroblast growth factor receptor-3 (FGFR3) defines a 20 distinct morphological subtype of high-grade urothelial carcinoma," J Pathol, 224(2):270-9, 20 pages.
Alazzouzi et al., (2005). "SMAD4 as a prognostic marker in colorectal cancer," Clinical cancer research, 11(7):2606-11.
Alberti et al., (2003). "RET and NTRK1 proto-oncogenes in human diseases," J Cell Physiol, 195:168-186.
Albertson (1984). "Localization of the ribosomal genes in Caenorhabditis elegans chromosomes by in situ hybridization using biotin-labeled probes," EMBO J., 3:1227-1234.
Almagro et al., (2008). "Humanization of antibodies," Front. Biosci., 13:1619-1633.
Altschul et al., (1990). "Basic local alignment search tool," J. Mol Biol., 215:403-410.
Altschul et al., (1997). "Gapped BLAST and PSI-BLAST: a new generation of protein database search programs," Nucleic Acids Res., 25(17):3389-3402.
Andoniou et al., (1994). "Tumour induction by activated abl involves tyrosine phosphorylation of the product of the cbl oncogene," EMBO J, 13(19):4515-23.
Arbitrario et al., (2010). "SNS-314, a pan-Aurora kinase inhibitor, shows potent anti-tumor activity and dosing flexibility in vivo," Cancer Chemother Pharmacol., 65(4):707-717. Abstract Only.
Baca et al., (1997). "Antibody humanization using monovalent phage display," J. Biol. Chem., 272(16):10678-10684.
Bacher et al., (2010). "Mutations of the TET2 and CBL 20 genes: novel molecular markers in myeloid malignancies," Ann Hematol, 89(7):643-52.
Banerji et al., (1983). "A lymphocyte-specific cellular enhancer is located downstream of the joining region in immunoglobulin heavy chain genes," Cell, 33(3):729-740.
Baraniskin et al., (2011). "A Prognostic value of reduced SMAD4 expression in patients with metastatic colorectal cancer under oxaliplatin-containing chemotherapy: a translational study of the AIO colorectal study group," Clinical colorectal cancer, 10(1):24-9. Abstract Only.
Barringer et al., (1990). "Blunt-end and single-strand ligations by *Escherichia coli* ligase: influence on an in vitro amplification scheme," Gene, 89(1):117-122.
Bartel et al., (1993). "Isolation of new ribozymes from a large pool of random sequences," Science, 261(5127):1411-1418.
Beaucage et al., (1981). "Deoxynucleoside phosphoramidites—A new class of key intermediates for deoxypolynucleotide synthesis," Tetrahedron Letters, 22(20):1859-1862.
Beidler et al., (1988). "Cloning and high level expression of a chimeric antibody with specificity for human carcinoembryonic antigen," J. Immunol., 141(11):4053-4060.
Beimfohr et al., (1999). "NTRK1 re-arrangement in papillary thyroid carcinomas of children after the Chernobyl reactor accident," Int J Cancer, 80(6):842-7.

(56) References Cited

OTHER PUBLICATIONS

Bernt et al., (2011). "A role for DOT1L in MLL-rearranged leukemias," Epigenomics, 3(6):667-70.
Bernt et al., (2011). "MLL-rearranged leukemia is dependent on aberrant H3K79 methylation by DOT1L," Cancer Cell, 20(1):66-78.
Better et al. (1988). "*Escherichia coli* secretion of an active chimeric antibody fragment," Science, 240(4855):1041-1043.
Bhatia et al., (2011). "Immunobiology of Merkel cell carcinoma: implications for immunotherapy of a polyomavirus-associated cancer," Curr. Oncol. Rep., 13(6):488-497.
Billy et al., (2001). "Specific interference with gene expression induced by long, double-stranded RNA in mouse embryonal teratocarcinoma cell lines," Proc. Natl. Sci. USA, 98(25):14428-14433.
Birch et al., (2011). "Chromosome 3 Anomalies Investigated by Genome Wide SNP Analysis of Benign, Low Malignant Potential and Low Grade Ovarian Serous Tumours," PLOS One, 6:e28250, 20 pages.
Boerner et al., (1991). "Production of antigen-specific human monoclonal antibodies from in vitro-primed human splenocytes," J. Immunol., 147(1):86-95.
Borrow et al., (1996). "The translocation t(8;16)(p11;p13) of acute myeloid leukaemia fuses a putative 25 acetyltransferase to the CREB-binding protein," Nat Genet, 14(1):33-41.
Bouhana et al., (2012). "Abstract 1798: Identification of pan-Trk inhibitors for the treatment of Trk-driven cancers," Cancer Res, 72(8 Suppl):1798, 2 pages.
Bown, (2001). "Neuroblastoma tumour genetics: clinical and biological aspects," J Clin Pathol, 54(12):897-910.
Branton et al., (2008). "The potential and challenges of nanopore sequencing," Nat Biotechnol., 26(10):1146-1153.
Brennan et al., (1985). "Preparation of bispecific antibodies by chemical recombination of monoclonal immunoglobulin G1 fragments," Science, 229(4708):81-83.
Brenner et al., (2011). "Mechanistic rationale for inhibition of poly(ADP-ribose) polymerase in ETS gene fusion-positive prostate cancer," Cancer Cell, 19(5):664-78.
Brodeur et al., (2009). "Trk receptor expression and inhibition in neuroblastomas," Clin Cancer Res, 15(10):3244-50.
Bruggemann et al., (1987). "Comparison of the effector functions of human immunoglobulins using a matched set of chimeric antibodies," J. Exp. Meet., 166(5):1351-1361.
Butler et al., (2008). "ALLPATHS: de novo assembly of whole-genome shotgun microreads," Genome Res., 18(5):810-820.
Butti et al., (1995). "A sequence 10 analysis of the genomic regions involved in the rearrangements between TPM3 and NTRK1 genes producing TRK oncogenes in papillary thyroid carcinomas," Genomics, 28(1):15-24.
Byrne et al., (1989). "Multiplex gene regulation: a two-tiered approach to transgene regulation in transgenic mice," Proc. Natl. Acad Sci. USA, 86(14):5473-5477.
Calame et al., (1988). "Transcriptional controlling elements in the immunoglobulin and T cell receptor loci," Adv. Immunol., 43:235-275.
Camper et al., (1989). "Postnatal repression of the alpha-fetoprotein gene is enhancer independent," Genes Dev., 3(4):537-546.
Carboni et al., (2009). "BMS-754807, a small molecule inhibitor of insulin-like growth factor-1R/IR," Mol Cancer Ther., 8(12):3341-3349.
Carell et al., (1994). "A Solution-Phase Screening Procedure for the Isolation of Active Compounds from a Library of Molecules," Angew. Chem. Int. Ed. Engl., 33(20):2061-2064.
Carrell et al., (1994). "A Novel Procedure for the Synthesis of Libraries Containing Small Organic Molecules," Angew. Chem. Int. Ed. Engl., 33(20):2059-2061.
Carrillo de Santa Pau et al., (2009). "Prognostic significance of the expression of vascular endothelial growth factors A, B, C, and D and their receptors R1, R2, and R3 in patients with nonsmall cell lung cancer," Cancer, 115(8):1701-1712.
Carter et al., (1992). "Humanization of an anti-p185HER2 antibody for human cancer therapy," Proc. Natl. Acad. Sci. USA, 89(10):4285-4289.
Carver et al., (2009). "Aberrant ERG expression cooperates with loss of PTEN to promote cancer progression in the prostate," Nat Genet, 41(5):619-24, 14 pages.
Chan et al., (2008). "A phase I trial of CEP-701 + gemcitabine in patients with advanced adenocarcinoma of the pancreas," Invest New Drugs, 26(3):241-7.
Chase et al., (2012). "Ponatinib as targeted therapy for FGFR1 fusions associated with the 8p11 myeloproliferative syndrome," Haematologica, 98:103-6.
Chen et al., (1999). "Selection and analysis of an optimized anti-VEGF antibody: crystal structure of an affinity-matured Fab in complex with antigen," J Mol Biol., 293(4):865-881.
Chi et al., (2012). "ETV6-NTRK3 as a therapeutic target of small molecule inhibitor PKC412," Biochem Biophys Res Commun., 429(1-2):87-92. Abstract Only.
Cho et al., (1993). "An unnatural biopolymer," Science, 261(5126):1303-1305.
Chowdhury (2008). "Engineering hot spots for affinity enhancement of antibodies," Methods Mol. Biol., 207:179-196.
Chu et al., (2008). "Potent RNAi by short RNA triggers," RNA, 14(9):1714-1719.
Clackson et al., (1991). "Making antibody fragments using phage display libraries," Nature, 352(6336):624-628.
Clark et al., (2007). "Diversity of TMPRSS2-ERG fusion transcripts in the human prostate," Oncogene, 26(18):2667-73.
Clark et al., (2009). "ETS gene fusions in prostate cancer," Nat Rev Urol., 6(8):429-39.
Clemens et al., (2000). "Use of double-stranded RNA interference in *Drosophila* cell lines to dissect signal transduction pathways," Proc. Natl. Acad. Sci. USA, 97(12):6499-6503.
Clynes et al., (1998). "Fc receptors are required in passive and active immunity to melanoma," Proc. Nat'l Acad. Sci. USA, 95:652-656.
Cocco et al., (2019). "Resistance to TRK inhibition mediated by convergent MAPK pathway activation," Nat Med., 25(9):1422-1427. Abstract Only.
Cohen et al., (1996). "Emerging technologies for sequencing antisense oligonucleotides: capillary electrophoresis and mass spectrometry," Adv Chromatogr., 36:127-162.
Cragg et al., (2003). "Complement-mediated lysis by anti-CD20 mAb correlates with segregation into lipid rafts," Blood, 101(3):1045-1052.
Cronin et al. (2004). "Measurement of gene expression in archival paraffin-embedded tissues: development and performance of a 92-gene reverse transcriptase-polymerase chain reaction assay," Am J Pathol., 164(1):35-42.
Cui et al., (2011). "Structure Based Drug Design of Crizotinib (PF-02341066), a Potent and Selective Dual Inhibitor of Mesenchymal-Epithelial Transition Factor (c-MET) Kinase and Anaplastic Lymphoma Kinase (ALK)," J Med Chem, 54:6342-6363.
Cull et al., (1992). "Screening for receptor ligands using large libraries of peptides linked to the C terminus of the lac repressor," Proc Natl Acad Sci USA, 89(5):1865-1869.
Cunningham et al., (1989). "High-resolution epitope mapping of hGH-receptor interactions by alanine-scanning mutagenesis," Science, 244(4908):1081-1085.
Curran et al., (2012). "Crizotinib: in locally advanced or metastatic non-small cell lung cancer," Drugs, 72(1):99-107.
Cwirla et al., (1990). "Peptides on phage: a vast library of peptides for identifying ligands," Proc. Natl. Acad. Sci., 87(16):6378-6382.
Daigle et al., (2011). "Selective killing of mixed lineage leukemia cells by a potent small-molecule DOT1L inhibitor," Cancer Cell, 20(1):53-65.
Dall'Acqua et al., (2005). "Antibody humanization by framework shuffling," Methods, 36(1):43-60.
Davies et al., (2012). "Identifying and targeting ROS1 gene fusions in non-small cell lung cancer," Clin Cancer Res., 18(17):4570-4579.
De Braekeleer et al., (2012). "MLL-ELL fusion gene 15 in two infants with acute monoblastic leukemia and myeloid sarcoma," Leukemia Lymphoma, 53(6):1222-4.

(56) References Cited

OTHER PUBLICATIONS

Demetri et al., (2018). “Efficacy and safety of entrectinib in patients with NTRK fusion-positive (NTRK-fp) Tumors: Pooled analysis of STARTRK-2, STARTRK-1 and ALKA-372-001,” ESMO, 29(S8), 1 page.
Devlin et al., (1990). “Random peptide libraries: a source of specific protein binding molecules,” Science, 249(4967):404-406.
DeWitt et al., (1993). ““Diversomers”: an approach to nonpeptide, nonoligomeric chemical diversity,” Proc. Natl. Acad Sci. U.S.A., 90(15):6909-6913.
Diep et al., (2012). “Down-regulation of Yes Associated Protein 1 expression reduces cell proliferation and clonogenicity of pancreatic cancer cells,” PloS one, 7(3):e32783, 9 pages.
Doebele et al., (2012). “Mechanisms of resistance to crizotinib in patients with ALK gene rearranged non-small cell lung cancer,” Clin Cancer Res, 18:1472-1482.
Doebele et al., (2018). “Efficacy and Safety of Entrectinib in Locally Advanced or Metastatic ROS1-Positive Non-Small Cell Lung Cancer (NSCLC),” IASLC 19th World Conference on Lung Cancer; Abstract No. 0A02.01.
Doebele et al., (2019). “Time-to-treatment discontinuation (TTD) and real-world progression-free survival (rwPFS) as endpoints for comparative efficacy analysis between entrectinib trial and crizotinib real-world ROS1 fusion-positive (ROS1+) NSCLC patients,” 2019 ASCO Annual Meeting I; ASCO Abstract 9070.
Dong et al., (2012). “Inactivation of MYOSB Promotes Invasion and Motility in Gastric Cancer Cells,” Digestive diseases and sciences, 57:1247-52.
Donnem et al., (2011). “Prognostic impact of angiogenic markers in non-small-cell lung cancer is related to tumor size,” Clin Lung Cancer, 12:106-15.
Drilon et al., (2017). “Safety and Antitumor Activity of the Multitargeted Pan-TRK, ROS1, and ALK Inhibitor Entrectinib: Combined Results from Two Phase I Trials (ALKA-372-001 and STARTRK-1),” Cancer Discov., 7(4):400-409.
Drilon et al., (2018). “Efficacy of Larotrectinib in TRK Fusion-Positive Cancers in Adults and Children,” N Engl J Med., 378(8):731-739.
Duijkers et al., (2012). “High anaplastic lymphoma kinase immunohistochemical staining in neuroblastoma and ganglioneuroblastoma is an independent predictor of poor outcome,” Am J Pathol, 180(3):1223-31.
Duncan et al., (1988). “The binding site for C1q on IgG,” Nature, 322(6166):738-740.
Edgar, (2006). “From cell structure to transcription: Hippo forges a new path,” Cell, 124(2):267-73.
Edlund et al., (1985). “Cell-specific expression of the rat insulin gene: evidence for role of two distinct 5' flanking elements,” Science, 230(4728):912-916.
Edwards et al., (2005). “Mass-spectrometry DNA sequencing,” Mut. Res., 573(1-2):3-12. Abstract Only.
Elbashir et al., (2001). “Duplexes of 21-nucleotide RNAs mediate RNA interference in cultured mammalian cells,” Nature, 411(6836):494-498.
Elbashir et al., (2001). “Functional anatomy of siRNAs for mediating efficient RNAi in *Drosophila melanogaster* embryo lysate,” EMBO, 20(23):6877-6888.
Elmen et al., (2005). “Locked nucleic acid (LNA) mediated improvements in siRNA stability and functionality,” Nucleic Acids Research, 33(1):439-447.
El-Osta et al., (2011). “BRAF mutations in advanced cancers: clinical characteristics and outcomes,” PLoS One, 6(10):e25806, 13 pages.
Erb et al., (1994). “Recursive deconvolution of combinatorial chemical libraries,” Proc. Natl. Acad Sci. USA, 91(24):11422-11426.
Falk et al., (2011). “An efficient high-throughput screening method for MYST family acetyltransferases, a new class of epigenetic drug targets,” J Biomol Screen, 16(10):1196-205.
Faria et al., (2001). “Phosphoramidate oligonucleotides as potent antisense molecules in cells and in vivo,” Nature Biotech., 19(1):40-44.
Felici et al., (1991). “Selection of antibody ligands from a large library of oligopeptides expressed on a multivalent exposition vector,” J. Mol. Biol., 222(2):301-310.
Fellouse et al., (2004). “Synthetic antibodies from a four-amino-acid code: a dominant role for tyrosine in antigen recognition,” Proc. Natl. Acad. Sci. USA, 101(34):12467-12472.
Feng et al., (2002). “Methylation of H3-lysine 79 is mediated by a new family of HMTases without a SET domain,” Curr Biol., 12(12):1052-8.
Feng et al., (2011). “RNAi-mediated silencing of VEGF-C inhibits non-small cell lung cancer progression by simultaneously down-regulating the CXCR4, CCR7, VEGFR-2 and VEGFR-3-dependent axes-induced ERK, p38 and AKT signalling pathways,” Eur J Cancer, 47:2353-63.
Fletcher et al., (2011). “ENMD-2076 is an orally active kinase inhibitor with antiangiogenic and antiproliferative mechanisms of action,” Mol Cancer Ther., 10(1):126-137.
Fodor et al., (1993). “Multiplexed biochemical assays with biological chips,” Nature, 364(6437):555-556.
Fountzilas et al., (2008). “Gemcitabine combined with gefitinib in patients with inoperable or metastatic pancreatic cancer: a phase II Study of the Hellenic Cooperative Oncology Group with biomarker evaluation,” Cancer Invest, 26(8):784-93.
Fuchs et al., (1991). “Targeting Recombinant Antibodies to the Surface of *Escherichia coli*: Fusion to a Peptidoglycan Associated Lipoprotein,” Nature Biotechnology, 9:1370-1372.
Fuehrer et al., (2012). “ALK-1 protein expression and ALK gene rearrangements aid in the diagnosis of inflammatory myofibroblastic tumors of the female genital tract,” Arch Pathol Lab Med, 136(6):623-6.
Fuse et al., (2017). “Mechanisms of Resistance to NTRK Inhibitors and Therapeutic Strategies in NTRK1-Rearranged Cancers,” Molecular Cancer Therapeutics, 16(10):2130-2143.
Gallop et al., (1994). “Applications of combinatorial technologies to drug discovery. 1. Background and peptide combinatorial libraries,” J. Med. Chem., 37(9):1233-1251.
Gaultier et al., (1987). “Alpha-DNA. IV: Alpha-anomeric and beta-anomeric tetrathymidylates covalently linked to intercalating oxazolopyridocarbazole. Synthesis, physicochemical properties and poly (rA) binding,” Nucleic Acids. Res., 15(16):6625-6641.
Gazzano-Santoro et al., (1996). “A non-radioactive complement-dependent cytotoxicity assay for anti-CD20 monoclonal antibody,” J. Immunol. Methods, 202(2):163-171.
George et al., (1999). “Sustained in Vivo Regression of Dunning H Rat Prostate Cancers Treated with Combinations of Androgen Ablation and Trk Tyrosine Kinase Inhibitors, CEP-751 (KT-6587) or CEP-701 (KT-5555),” Cancer Res, 59(10):2395-2401, 21 pages.
Gervais et al., (2011). “Phase II study of sunitinib as maintenance therapy in patients with locally advanced or metastatic non-small cell lung cancer,” Lung Cancer 74(3):474-80.
Ginzonger et al., (2000). “Measurement of DNA copy number at microsatellite loci using quantitative PCR analysis,” Cancer Research, 60(19):5405-5409.
Gluzman (1981). “SV40-transformed simian cells support the replication of early SV40 mutants,” Cell, 23(1):175-182.
Gnirke et al., (2009). “Solution hybrid selection with ultra-long oligonucleotides for massively parallel targeted sequencing,” Nat Biotechnol., 27(2):182-189.
Gollob et al., (2006). “Role of Raf kinase in cancer: therapeutic potential of targeting the Raf/MEK/ERK signal transduction pathway,” Semin Oncol, 33(4):392-406.
Gossen et al., (1992). “Tight control of gene expression in mammalian cells by tetracycline-responsive promoters,” Proc. Natl. Acad Sci. USA, 89(12):5547-5551.
Grande et al., (2011). “Targeting oncogenic ALK: a promising strategy for cancer treatment,” Mol Cancer Ther, 10(4):569-79.
Griffin et al., (1993). “DNA sequencing. Recent innovations and future trends,” Appl Biochem Biotechnol., 38(1-2):147-159.
Griffiths et al., (1993). “Human anti-self antibodies with high specificity from phage display libraries,” EMBO J., 12(2):725-734.

(56) References Cited

OTHER PUBLICATIONS

Gruber et al., (1994). "Efficient tumor cell lysis mediated by a bispecific single chain antibody expressed in *Escherichia coli*," J. Immunol., 152(11):5368-5374.
Grunweller et al., (2003). "Comparison of different antisense strategies in mammalian cells using locked nucleic acids, 2'-O-methyl RNA, phosphorothioates and small interfering RNA," Nucleic Acids Research, 31(12):3185-3193.
Gu et al., (2011). "Survey of Tyrosine Kinase Signaling Reveals ROS Kinase Fusions in Human Cholangiocarcinoma," PLoS One, 6:e15640, 9 pages.
Guatelli et al. (1990). "Isothermal, in vitro amplification of nucleic acids by a multienzyme reaction modeled after retroviral replication," Proc. Nat. Acad. Sci. USA, 87(5):1874-1878.
Gudernova et al., (2017). "Inhibitor repurposing reveals ALK, LTK, FGFR, RET and TRK kinases as the targets of AZD1480," Oncotarget, 8(65):109319-109331.
Guyer et al., (1976). "Immunoglobulin binding by mouse intestinal epithelial cell receptors," J. Immunol., 117(2):587-593.
Hanna et al., (2000). "Comparison of sequencing by hybridization and cycle sequencing for genotyping of human immunodeficiency virus type 1 reverse transcriptase," J. Clin. Microbiol., 38(7):2715-2721.
Hara et al., (1998). "Amplification of c-myc, K-sam, and c-met in gastric cancers: detection by fluorescence in situ hybridization," Lab Invest, 78(9):1143-53.
Harper et al., (2008). "Chromosomal rearrangements leading to MLL gene fusions: clinical and biological aspects," Cancer research, 68(24):10024-7, 7 pages.
Harvey et al., (2007). "The Salvador-Warts-Hippo 20 pathway—an emerging tumour-suppressor network," Nature reviews Cancer, 7(3):182-91.
Haselhoff et al., (1988). "Simple RNA enzymes with new and highly specific endoribonuclease activities," Nature, 334(6183):585-591.
Hatzivassiliou et al., (2010). "RAF inhibitors prime wild-type RAF to activate the MAPK pathway and enhance growth," Nature, 464(7287):431-5.
Hay et al., (1992). "Bacteriophage cloning and *Escherichia coli* expression of a human IgM Fab," Hum. Antibod. Hybridomas, 3(2):81-85.
Heiskanen et al., (2001). "CGH, cDNA and tissue microarray analyses implicate FGFR2 amplification in a small subset of breast tumors," Anal Cell Pathol, 22(4):229-34.
Helene (1991). "The anti-gene strategy: control of gene expression by triplex-forming-oligonucleotides," Anticancer Drug Des., 6(6):569-584.
Helene et al., (1992). "Control of gene expression by triple helix-forming oligonucleotides. The antigene strategy," Ann. N.Y. Acad. Sci., 660:27-36.
Helias-Rodzewicz et al., (2010). "YAP1 and VGLL3, encoding two cofactors of TEAD transcription factors, are amplified and overexpressed in a subset of soft tissue sarcomas," Genes, chromosomes cancer, 49(12):1161-71.
Hellstrom et al., (1985). "Strong antitumor activities of IgG3 antibodies to a human melanoma-associated ganglioside," Proc. Nat'l Acad. Sci. USA, 82(5):1499-1502.
Hellstrom et al., (1986). "Antitumor effects of L6, an IgG2a antibody that reacts with most human carcinomas," Proc. Nat'l Acad. Sci. USA, 83(18):7059-7063.
Hermans et al., (2009). "Overexpression of prostate-specific TMPRSS2(exon 0)-ERG fusion transcripts corresponds with favorable prognosis of 5 prostate cancer," Clin Cancer Res, 15(20):6398-403.
Herquel et al., (2011). "Transcription cofactors TRIM24, TRIM28, and TRIM33 associate to form regulatory complexes that suppress murine hepatocellular carcinoma," Proc Natl Acad Sci USA, 108(20):8212-7.
Hess, (2004). "MLL: a histone methyltransferase disrupted in leukemia," Trends in molecular medicine, 10(10):500-7.
Hollinger et al., (1993). "Diabodies': small bivalent and bispecific antibody fragments," Proc. Natl. Acad. Sci. USA, 90(14):6444-6448.
Hoogenboom et al., (1992). "By-passing immunisation. Human antibodies from synthetic repertoires of germline VH gene segments rearranged in vitro," J Mol Biol., 227(2):381-388.
Hoogenboom et al., (2002). "Overview of antibody phage-display technology and its applications," Methods in Molecular Biology, 178:1-37.
Houghten et al., (1992). "The use of synthetic peptide combinatorial libraries for the identification of bioactive peptides," Biotechniques, 13(3):412-421.
Hudson et al., (2003). "Engineered antibodies," Nat. Med., 9(1):129-134.
Huse et al., (1989). "Generation of a large combinatorial library of the immunoglobulin repertoire in phage lambda," Science, 246(4935):1275-1281.
Hyman et al., (2019). "445PD—Durability of response with larotrectinib in adult and pediatric patients with TRK fusion cancer," Annals of Oncology, 30(S5):v162-v163.
Hyrup et al., (1996). "Peptide nucleic acids (PNA): synthesis, properties and potential applications," Bioorganic & Medicinal Chemistry, 4(1):5-23.
Idusogie et al., (2000). "Mapping of the C1q binding site on rituxan, a chimeric antibody with a human IgG1 Fc," J. Immunol., 164(8):4178-4184.
Imanishi et al., (2002). "BNAs: novel nucleic acid analogs with a bridged sugar moiety," Chem. Commun., 16:1653-1659.
Inoue et al., (1987). "Sequence-dependent hydrolysis of RNA using modified oligonucleotide splints and RNase H," FEBS Lett., 215(2):327-330.
Inoue et al., (1987). "Synthesis and hybridization studies on two complementary nona(2'-O-methyl)ribonucleotides," Nucleic Acids Res., 15(15):6131-6148.
Isaksson-Mettavainio et al., (2011). "High SMAD4 levels appear in microsatellite instability and hypermethylated colon cancers and indicate a better prognosis. International journal of cancer," Int J Cancer, 131:779-88.
Jain et al., (2011). "Association of overexpression of TIF1? with colorectal carcinogenesis and advanced colorectal 5 adenocarcinoma," World journal of gastroenterology, 17(35):3994-4000.
Jani et al., (2010). "PF-03814735, an orally bioavailable small molecule aurora kinase inhibitor for cancer therapy," Mol Cancer Ther., 9(4):883-894.
Jepson et al., (2004). "Locked nucleic acid: a potent nucleic acid analog in therapeutics and biotechnology," Oligonucleotides, 14(2):130-146. Abstract Only.
Jin et al., (2011). "The driver of malignancy in KG-la leukemic cells, FGFR10P2-FGFR1, encodes an HSP90 addicted oncoprotein," Cell Signal, 23(11):1758-66.
Jones et al., (1986). "Replacing the complementarity-determining regions in a human antibody with those from a mouse," Nature, 321(6069):552-525.
Jones et al., (2009). "Oncogenic RAF1 rearrangement and a novel BRAF mutation as alternatives to KIAA1549:BRAF fusion in activating the MAPK pathway in pilocytic astrocytoma," Oncogene, 28(20):2119-23, 8 pages.
Ju et al., (2012). "A transforming KIFSB and RET gene fusion in lung adenocarcinoma revealed from whole-genome and transcriptome sequencing," Genome Res, 22(3):436-45.
Kalampokas et al., (2017). "Primary Vaginal Melanoma, A Rare and Aggressive Entity. A Case Report and Review of the Literature," In Vivo, 31(1):133-140.
Kallioniemi et al., (1992). "ERBB2 amplification in breast cancer analyzed by fluorescence in situ hybridization," Proc. Natl Acad Sci USA, 89(12):5321-5325.
Kam et al., (2005). "Carbon nanotubes as multifunctional biological transporters and near-infrared agents for selective cancer cell destruction," Proc. Natl. Acad. Sci. USA, 102(33):11600-11605.
Kanda et al., (2006). "Comparison of cell lines for stable production of fucose-negative antibodies with enhanced ADCC," Biotechnol. Bioeng., 94(4):680-688.

(56) References Cited

OTHER PUBLICATIONS

Karlin et al., (1990). "Methods for assessing the statistical significance of molecular sequence features by using general scoring schemes," Proc. Natl. Acad. Sci. USA, 87(6):2264-2268.
Karlin et al., (1993). "Applications and statistics for multiple high-scoring segments in molecular sequences," Proc. Natl. Acad. Sci. USA, 90(12):5873-5877.
Kashmiri et al., (2005). "SDR grafting—a new approach to antibody humanization," Methods, 36(1):25-34.
Kessel et al., (1990). "Murine developmental control genes," Science, 249(4967):374-379.
Khotskaya et al., (2017). "Targeting TRK family proteins in cancer," Pharmacol Ther., 173:58-66. Abstract Only.
Khromova et al., (2012). "Downregulation of VEGF-C expression in lung and colon cancer cells decelerates tumor growth and inhibits metastasis via multiple mechanisms," Oncogene, 31(11):1389-97.
Kim et al., (1994). "Localization of the site of the murine IgG1 molecule that is involved in binding to the murine intestinal Fc receptor," Eur J Immunol., 24(10):2429-2434.
Kim et al., (2005). "Synthetic dsRNA Dicer substrates enhance RNAi potency and efficacy," Nat Biotech., 23(2):222-226.
Kim et al., (2012). "The ubiquitin-specific protease USP2a enhances tumor progression by targeting cyclin Al in bladder cancer," Cell Cycle, 11(6):1123-30.
King et al., (2009). "Cooperativity of TMPRSS2-ERG with PI3-kinase pathway activation in prostate oncogenesis," Nat Genet, 41(5):524-6, 8 pages.
Klein et al., (1991). "The trk proto-oncogene encodes a receptor for nerve growth factor," Cell, 65(1):189-97.
Klezovitch et al., (2008). "A causal role for ERG in neoplastic transformation of prostate epithelium," Proc Natl Acad Sci USA, 105(6):2105-10.
Klimka et al., (2000). "Human anti-CD30 recombinant antibodies by guided phage antibody selection using cell panning," Br. J. Cancer, 83(2):252-260.
Kohler et al., (1975). "Continuous cultures of fused cells secreting antibody of predefined specificity," Nature, 256(5517):495-497.
Kohno et al., (2012). "KIF5B-RET fusions in lung adenocarcinoma," Nat Med, 18(3):375-7, 7 pages.
Kostelny et al., (1992). "Formation of a bispecific antibody by the use of leucine zippers," J. Immunol., 148(5):1547-1553.
Kozbor et al., (1983). "The production of monoclonal antibodies from human lymphocytes," Immunol. Today, 4(3):72-79.
Kozbor et al., (1984). "A human hybrid myeloma for production of human monoclonal antibodies," J Immunol., 133(6):3001-3005.
Krishnakumar et al., (2008). "A comprehensive assay for targeted multiplex amplification of human DNA sequences," Proc. Natl. Acad. Sci. USA, 105(27):9296-9310.
Krivtsov et al., (2008). "H3K79 methylation profiles define murine and human MLL-AF4 leukemias," Cancer Cell, 14(5):355-68.
Kwak et al., (2010). "Anaplastic lymphoma kinase inhibition in non-small-cell lung cancer," N Engl J Med., 363(18):1693-1703.
Kwoh et al., (1989). "Transcription-based amplification system and detection of amplified human immunodeficiency virus type 1 with a bead-based sandwich hybridization format," Proc. Nail. Acad. Sci. USA, 86(4):1173-1177.
Lam (1997). "Application of combinatorial library methods in cancer research and drug discovery," Anticancer Drug Des., 12(3):145-167.
Lam et al., (1991). "A new type of synthetic peptide library for identifying ligand-binding activity," Nature, 354(6348):82-84.
Landegren et al., (1988). "A ligase-mediated gene detection technique," Science, 241(4869):1077-1080.
Lapointe et al., (2007). "A variant TMPRSS2 isoform and ERG fusion product in prostate cancer with implications for molecular diagnosis," Mod Pathol, 20(4):467-73.
Lasken (2007). "Single-cell genomic sequencing using Multiple Displacement Amplification," Curr Opin Microbiol., 10(5):510-516.
Lassen et al., (2018). "Abstract 4090: Larotrectinib efficacy and safety in TRK fusion cancer: an expanded clinical dataset showing consistency in an age and tumor agnostic approach," Annals of Oncology 29 (Supplement 8):viii133-viii148, 1 page.
Le Douarin et al., (1995). "The N-terminal part of TIF1, a putative mediator of the ligand-dependent activation function (AF-2) of nuclear receptors, is fused to B-raf in the oncogenic protein T18," EMBO J , 14(9):2020-33.
Lee et al., (2004). "Bivalent antibody phage display mimics natural immunoglobulin," J. Immunol. Methods, 284(1-2):119-132.
Lee et al., (2004). "High-affinity human antibodies from phage-displayed synthetic Fab libraries with a single framework scaffold," J. Mol. Biol., 340(5):1073-1093.
Lemaitre et al., (1987). "Specific antiviral activity of a poly(L-lysine)-conjugated oligodeoxyribonucleotide sequence complementary to vesicular stomatitis virus N protein mRNA initiation site," Proc. Natl. Acad. Sci. USA, 84(3):648-652.
Leng et al., (2009). "Smad4/Smad7 balance: a role of tumorigenesis in gastric cancer," Experimental and molecular pathology, 87(1):48-53.
Letsinger et al., (1989). "Cholesteryl-conjugated oligonucleotides: synthesis, properties, and activity as inhibitors of replication of human immunodeficiency virus in cell culture," Proc. Natl. Acad Sci. USA, 86(17):6553-6556.
Li et al., (2006). "Human antibodies for immunotherapy development generated via a human B cell hybridoma technology," Proc. Natl. Acad. Sci. USA, 103(10):3557-3562.
Li et al., (2011). "Roles of VEGF-C and Smad4 in the lymphangiogenesis, lymphatic metastasis, and prognosis in colon cancer," Journal of gastrointestinal surgery, 15(11):2001-10.
Lipson et al., (2012). "Identification of new ALK and RET gene fusions from colorectal and lung cancer biopsies," Nat Med, 18(3):382-4, 7 pages.
Liu et al., (1987). "Chimeric mouse-human IgG1 antibody that can mediate lysis of cancer cells," Proc. Natl. Acad. Sci. USA, 84(10):3439-3443.
Liu et al., (1987). "Production of a mouse-human chimeric monoclonal antibody to CD20 with potent Fc-dependent biologic activity," J Immunol. 139(10):3521-3526.
Liu et al., (2011). "FOXO1-FGFR1 fusion and amplification in a solid variant of alveolar rhabdomyosarcoma," Mod Pathol, 24(10):1327-35.
Lonberg (2005). "Human antibodies from transgenic animals," Nat. Biotech., 23(9):1117-1125.
Lonberg (2008). "Fully human antibodies from transgenic mouse and phage display platforms," Curr. Opin. Immunol., 20(4):450-459.
Lonberg et al., (1995). "Human antibodies from transgenic mice," Int. Rev. Immunol., 13(1):65-93.
Loughran et al., (2008). "The transcription factor Erg is essential for definitive hematopoiesis and the function of adult hematopoietic stem cells," Nat Immunol, 9(7):810-9.
Lucas et al., (2008). "The androgen-regulated type II serine protease TMPRSS2 is differentially expressed and mislocalized in prostate adenocarcinoma," J Pathol, 215(2):118-25. Abstract Only.
Maher (1992). "DNA triple-helix formation: an approach to artificial gene repressors?" Bioassays, 14(12):807-815.
Malkoski et al., (2012). "Two sides of the story? Smad4 loss in 20 pancreatic cancer versus head-and-neck cancer," FEBS letters, 586:1984-92.
Marks et al., (1992). "By-passing immunization. Human antibodies from V-gene libraries displayed on phage," J Mot Biol., 222(3):581-597.
Marks et al., (2004). "Selection of human antibodies from phage display libraries," Methods in Molecular Biology, 248:161-176.
Marschalek, (2011). "Mechanisms of leukemogenesis by MLL fusion proteins," British journal of haematology, 152:141-54.
Marshall et al., (2005). "Phase I trial of orally administered CEP-701, a novel neurotrophin receptor-linked tyrosine kinase inhibitor," Invest New Drugs, 23(1):31-7.
Martin (1995). "Ein neuer Zugang zu 2'-O-Alkylribonucleosiden und Eigenschaften deren Oligonucleotide," Helvetica, 78(2):486-504.

(56) References Cited

OTHER PUBLICATIONS

Massague, (2008). “TGFbeta in Cancer,” Cell, 34(2):215-30.
Masuda et al., (1999). “Analysis of chemical modification of RNA from formalin-fixed samples and optimization of molecular biology applications for such samples,” Nucleic Acids Res., 27(22):4436-4443.
Maurer et al., (2011). “Raf kinases in cancer-roles and therapeutic opportunities,” Oncogene, 30(32):3477-88.
Maxam et al., (1977). “A new method for sequencing DNA,” Proc. Nat! Acad Sci USA, 74(2):560-564.
Mayer et al., (1993). “The prognostic significance of proliferating cell nuclear antigen, epidermal growth factor receptor, and mdr gene expression in colorectal cancer,” Cancer, 71(8):2454-60.
Mayr et al., (2006). “KRAS and BRAF mutations in ovarian tumors: a comprehensive study of invasive carcinomas, borderline tumors and extraovarian implants,” Gynecol Oncol, 103(3):883-7.
McCafferty et al., (1990). “Phage antibodies: filamentous phage displaying antibody variable domains,” Nature, 348(6301):552-554.
Meric-Bernstam et al., (2018). “Activity of larotrectinib, a highly selective inhibitor of tropomyosin receptor kinase, in TRK fusion breast cancers”, SABCS Abstract P6-20-02.
Mesker et al., (2009). “Presence of a high amount of stroma and downregulation of SMAD4 predict for worse survival for stage I-II colon cancer patients,” Cellular oncology, 31(3):169-78.
Metzker (2010). “Sequencing technologies—the next generation,” Nature Biotechnology Reviews, 11(1):31-46.
Milstein et al., (1983). “Hybrid hybridomas and their use in immunohistochemistry,” Nature, 305(5934):537-540.
Minturn et al., (2011). “Phase I trial of lestaurtinib for children with refractory neuroblastoma: a new approaches to neuroblastoma therapy consortium study,” Cancer Chemother Pharmacol, 68(4):1057-65, 18 pages.
Miyaki et al., (1999). “Higher frequency of Smad4 gene mutation in human colorectal cancer with distant metastasis,” Oncogene, 18(20):3098-103.
Mizukawa et al., (2011). “Inhibition of Rac GTPase signaling and downstream prosurvival Bcl-2 proteins as combination targeted therapy in MLL-AF9 leukemia,” Blood, 118(19):5235-45.
Mody et al., (2015). “Integrative Clinical Sequencing in the Management of Refractory or Relapsed Cancer in Youth,” JAMA, 314(9):913-925.
Mok et al., (2009). “Gefitinib or Carboplatin-Paclitaxel in Pulmonary Adenocarcinoma,” N Engl J Med, 361:947-957.
Mook et al., (2007). “Evaluation of locked nucleic acid-modified small interfering RNA in vitro and in vivo,” Mol Cancer Ther., 6(3):833-843.
Morrison (1985). “Transfectomas provide novel chimeric antibodies,” Science, 229(4719):1202-1207.
Morrison et al., (1984). “Chimeric human antibody molecules: mouse antigen-binding domains with human constant region domains,” Proc. Natl. Acad. Sci. USA, 81(21):6851-6855.
Mulligan et al., (1994). “Specific mutations of the RET proto-oncogene are related to disease phenotype in MEN 2A and FMTC,” Nat Genet, 6(1):70-4.
Murati et al., (2009). “Genome profiling of acute myelomonocytic leukemia: alteration of the MYB locus in MYST3-linked cases,” Leukemia, 23(1):85-94.
Myers et al., (1988). “Optimal alignments in linear space,” Comput Appl Biosci, 4(1):11-17.
Nacu et al., (2011). “Deep RNA sequencing analysis of readthrough gene fusions in human prostate adenocarcinoma and reference samples,” BMC Med Genomics, 4:11.
Naeve et al., (1995). “Accuracy of automated DNA sequencing: a multi-laboratory comparison of sequencing results,” Biotechniques, 19(3):448-453.
Nakagawara, (2001). “Trk receptor tyrosine kinases: a bridge between cancer and neural development,” Cancer Lett 169(2):107-14.
Nakashima et al., (2007). “RET oncogene 10 amplification in thyroid cancer: correlations with radiation-associated and high-grade malignancy,” Hum Pathol, 38(4):621-8, 8 pages.
Natale et al., (2011). “Phase III trial of vandetanib compared with erlotinib in patients with previously treated advanced non-small-cell lung cancer,” J Clin Oncol, 29(8):1059-66.
Nath et al., (1998). “Fluorescence in situ hybridization (FISH): DNA probe production and hybridization criteria,” Biotechnic Histochem., 73(1):6-22.
Necchi et al., (2012). “Pazopanib in advanced and platinum-resistant urothelial cancer: an open-label, single group, phase 2 trial,” Lancet Oncol, 13(8):810-6.
Ni (2006). “Research progress and future perspectives in antibodomics and antibodomic Drugs,” J. General Review, 26(4):265-268. Abstract Only.
Nielsen et al., (1991). “Sequence-selective recognition of DNA by strand displacement with a thymine-substituted polyamide,” Science, 254(5037):1497-1500.
Nikiforov, (2008). “Thyroid carcinoma: molecular pathways and therapeutic targets,” Mod Pathol, 21(Suppl 2):S37-43.
Nishimura et al., (1987). “Recombinant human-mouse chimeric monoclonal antibody specific for common acute lymphocytic leukemia antigen,” Cancer Res., 47(4):999-1005.
Nishiyama et al., (2018). “Foretinib Overcomes Entrectinib Resistance Associated with the NTRK1 G667C Mutation in NTRK1 Fusion-Positive Tumor Cells in a Brain Metastasis Model,” Clin Cancer Res., 24(10):2357-2369.
Oi et al., (1986). “Chimeric antibodies,” BioTechniques, 4(3), 214-221.
Okada et al., (2005). “hDOT1L links histone methylation to leukemogenesis,” Cell, 121(2):167-78.
Okamura et al., (2018). “Analysis of NTRK Alterations in Pan-Cancer Adult and Pediatric Malignancies: Implications for NTRK-Targeted Therapeutics,” JCO Precis Oncol., PO.18.00183, 20 pages.
Okazaki et al., (2004). “Fucose depletion from human IgG1 oligosaccharide enhances binding enthalpy and association rate between IgG1 and FcgammaRIIIa,” J. Mol. Biol., 336(5):1239-1249.
Ono et al., (2009). “Mixed-lineage-leukemia (MLL) fusion protein collaborates with Ras to induce acute leukemia through aberrant Hox expression and Raf activation,” Leukemia, 23(12):2197-209.
Osbourn et al., (2005). “From rodent reagents to human therapeutics using antibody guided selection,” Methods, 36(1):61-68.
Overholtzer et al., (2006). “Transforming properties of YAP, a candidate oncogene on the chromosome 11q22 amplicon,” PNAS USA, 103(33):12405-10.
Padlan (1991). “A possible procedure for reducing the immunogenicity of antibody variable domains while preserving their ligand-binding properties,” Mol. Immunol., 28(4-5):489-498.
Paillard (1989). “‘Tet-on’: a gene switch for the exogenous regulation of transgene expression,” Human Gene Therapy, 9(7):983-985.
Palanisamy et al., (2010). “Rearrangements of the RAF kinase pathway in prostate cancer, gastric cancer and melanoma,” Nature medicine, 16(7):793-8, 6 pages.
Papageorgis et al., (2011). “Smad4 inactivation promotes malignancy and drug resistance of colon cancer,” Cancer research, 71(3):998-1008.
Park et al., (2016). “NTRK1 fusions for the therapeutic intervention of Korean patients with colon cancer,” Oncotarget, 7(7):8399-8412.
Pearson et al., (1988). “Improved tools for biological sequence comparison,” Proc. Natl. Acad. Sci. USA, 85(8): 2444-2448.
Peifer et al., (2012). “Integrative genome analyses identify key somatic driver mutations of small-cell lung cancer,” Nat Genet 44, 1104-1110, 22 pages.
Penault-Llorca et al., (2019). “Testing algorithm for identification of patients with TRK fusion cancer,” J Clin Pathol., 72(7):460-467.
Perner et al., (2006). “TMPRSS2:ERG fusion-associated deletions provide insight into the heterogeneity of prostate cancer,” Cancer Res, 66(17):8337-41.
Perry-O'Keefe et al., (1996). “Peptide nucleic acid pre-gel hybridization: an alternative to southern hybridization,” Proc. Natl. Acad. Sci., 93(25):14670-14675.
Petkova et al., (2006). “Enhanced half-life of genetically engineered human IgG1 antibodies in a humanized FcRn mouse model: potential application in humorally mediated autoimmune disease,” Intl. Immunol., 18(12):1759-1769.

(56) References Cited

OTHER PUBLICATIONS

Phay et al., (2010). "Targeting RET receptor tyrosine kinase activation in cancer," Clin Cancer Res, 16(24):5936-41.
Pinkel et al., (1988). "Fluorescence in situ hybridization with human chromosome-specific libraries: detection of trisomy 21 and translocations of chromosome 4," Proc. Natl. Acad. Sci. USA, 85(23):9138-9142.
Pinkel et al., (1998). "High resolution analysis of DNA copy number variation using comparative genomic hybridization to microarrays," Nature Genetics, 20(2):207-211.
Pinkert et al., (1987). "An albumin enhancer located 10 kb upstream functions along with its promoter to direct efficient, liver-specific expression in transgenic mice," Genes Dev., 1(3):268-277.
Pontes et al., (2010). "Immunoexpression of Ki67, proliferative cell nuclear antigen, and Bcl-2 proteins in a case of ameloblastic fibrosarcoma," Annals of diagnostic pathology, 14(6):447-52.
Porreca et al., (2007). "Multiplex amplification of large sets of human exons," Nature Methods, 4(11):931-936.
Presta et al., (1993). "Humanization of an antibody directed against IgE," J. Immunol, 151(5):2623-2632.
Presta et al., (1997). "Humanization of an anti-vascular endothelial growth factor monoclonal antibody for the therapy of solid tumors and other disorders," Cancer Res., 57(20):4593-4599.
Qiu et al., (2008). "Mechanism of activation and inhibition of the HER4/ErbB4 kinase," Structure, 16(3):460-7.
Queen et al., (1983). "Immunoglobulin gene transcription is activated by downstream sequence elements," Cell, 33(3):741-748.
Queen et al., (1989). "A humanized antibody that binds to the interleukin 2 receptor," Proc. Nat'l Acad. Sci. USA, 86(24):10029-10033.
Ravetch et al., (1991). "Fc receptors," Annu. Rev. Immunol., 9:457-492.
Reindl et al., (2009). "CBL exon 8/9 mutants activate the FLT3 pathway and cluster in core binding factor/11q deletion acute myeloid leukemia/myelodysplastic syndrome subtypes," Clin Cancer Res, 15(7):2238-47.
Ren et al., (2011). "Src activation plays an important key role in lymphomagenesis induced by FGFR1 fusion kinases," Cancer Res, 71(23):7312-22.
Riechmann et al., (1988). "Reshaping human antibodies for therapy," Nature, 332(6162):323-329.
Ripka et al., (1986). "Two Chinese hamster ovary glycosylation mutants affected in the conversion of GDP-mannose to GDP-fucose," Arch. Biochem. Biophys., 249(2):533-545.
Robinson et al., (2019). "Phase 1/1B trial to assess the activity of entrectinib in children and adolescents with recurrent or refractory solid tumors including central nervous system (CNS) tumors," 2019 ASCO Annual Meeting I, ASCO Abstract 10009.
Roland et al., (2011). "Rab GTPase-Myo5B complexes control membrane recycling and epithelial polarization," PNAS, 108(7):2789-94.
Roongjang et al., (2007). "Inhibition of bcl-xLexpression by antisense oligonucleotides containing various bridged nucleic acids (BNAs)," Nucleic Acids Symp Ser, 51:113-114.
Rosok et al., (1996). "A combinatorial library strategy for the rapid humanization of anticarcinoma BR96 Fab," J. Biol. Chem., 271(37):22611-22618.
Safran et al., (2008). "Lapatinib/gemcitabine and lapatinib/gemcitabine/oxaliplatin: a phase I study for advanced pancreaticobiliary cancer," Am J Clin Oncol, 31(2):140-4.
Sameer et al., (2010). "SMAD4—molecular gladiator of the TGF-beta signaling is trampled upon by mutational insufficiency in colorectal carcinoma of Kashmiri population: an analysis with relation to KRAS proto-oncogene," BMC cancer, 10:300, 11 pages.
Sanger et al., (1977). "DNA sequencing with chain-terminating inhibitors," Proc. Nat. Acad. Sci, 74(12):5463-5467.
Sasaki et al., (2011). "A novel ALK secondary mutation and EGFR signaling cause resistance to ALK kinase inhibitors," Cancer Res, 71:6051-6060.
Scheble et al., (2010). "ERG rearrangement is specific to prostate cancer and does not occur in any of her common tumor," Mod Pathol, 23(8):1061-7.
Schram et al., (2017). "Potential role of larotrectinib (LOXO-101), a selective pan-TRK inhibitor, in NTRK fusion-positive recurrent glioblastoma," AACR Annual Meeting 2017, AACR abstract LB-302, 1 page.
Scott et al., (1990). "Searching for peptide ligands with an epitope library," Science, 249(4967):386-390.
Shaw et al., (1988). "Mouse/human chimeric antibodies to a tumor-associated antigen: biologic activity of the four human IgG subclasses," J. Natl. Cancer Inst. 80(19):1553-1559.
Shaw et al., (2012). "LBA1_PR—Phase III Study of Crizotinib Versus Pemetrexed or Docetaxel Chemotherapy in Patients with Advanced Alk-Positive Non-Small Cell Lung Cancer (NSCLC) (Profile 1007)," Annals of Oncology, 23(9):ixe21, 1 page.
Shi et al., (2011). "Ubiquitin-specific cysteine protease 2a (USP2a) regulates the stability of Aurora-A," J Biol Chem, 286(45):38960-8.
Shields et al., (2001). "High resolution mapping of the binding site on human IgG1 for Fc gamma RI, Fc gamma RII, Fc gamma RIII, and FcRn and design of IgG1 variants with improved binding to the Fc gamma R," J. Biol. Chem., 9(2):6591-6604.
Shimomura et al., (2010). "MK-5108, a highly selective Aurora-A kinase inhibitor, shows antitumor activity alone and in combination with docetaxel," Mol Cancer Ther., 9(1):157-166.
Si et al., (2012). "Prevalence of BRAF V600E mutation in Chinese melanoma patients: large scale analysis of BRAF and NRAS mutations in a 432-case cohort," Eur J Cancer, 48(1):94-100. Abstract Only.
Sidhu et al., (2004). "Phage-displayed antibody libraries of synthetic heavy chain complementarity determining regions," J Mot Biol., 338(2):299-310.
Siena et al., (2019). "Efficacy of entrectinib in patients (pts) with solid tumors and central nervous system (CNS) metastases: Integrated analysis from three clinical trials," 2019 ASCO Annual Meeting I, ASCO Abstract 3017.
Sims et al., (1993). "A humanized CD18 antibody can block function without cell destruction," J. Immunol., 151(4):2296-2308.
Siolas et al., (2005). "Synthetic shRNAs as potent RNAi triggers," Nat. Biotechnol., 23(2):227-231.
Sjolander et al., (1991). "Integrated fluid handling system for biomolecular interaction analysis," Anal. Chem., 63(20):2338-2345.
Smith et al., (1988). "Single-step purification of polypeptides expressed in *Escherichia coli* as fusions with glutathione S-transferase," Gene, 67(1):31-40.
Smith et al., (2018). "Antitumor Activity of Entrectinib, a Pan-TRK, ROS1, and ALK Inhibitor, in ETV6-NTRK3-Positive Acute Myeloid Leukemia," Mol Cancer Ther., 17(2):455-463.
Socinski, (2011). "Multitargeted receptor tyrosine kinase inhibition: an antiangiogenic strategy in non-small cell lung cancer," Cancer Treat Rev, 37(8):611-7. Abstract Only.
Soda et al., (2007). "Identification of the transforming EML4-ALK fusion gene in non-small-cell lung cancer," Nature, 448:561-566.
Specht et al., (2001). "Quantitative gene expression analysis in microdissected archival formalin-fixed and paraffin-embedded tumor tissue," Am J Pathol., 158(2):419-429.
Spigel et al., (2011). "Randomized, double-blind, placebo-controlled, phase II trial of sorafenib and erlotinib or erlotinib alone in previously treated advanced non-small-cell lung cancer," J Clin Oncol, 29(18):2582-9.
Stanton et al., (1989). "Definition of the human raf amino-30 terminal regulatory region by deletion mutagenesis," Molecular and cellular biology, 9(2):639-47.
Stephens et al., (1994). "Trk receptors use redundant signal transduction pathways involving SHC and PLC-gamma 1 to mediate NGF responses," Neuron, 12(3):691-705.
Sukov et al., (2007). "Utility of ALK-1 protein expression and ALK rearrangements in distinguishing inflammatory myofibroblastic tumor from malignant spindle cell lesions of the urinary bladder," Mod Pathol, 20(5):592-603.

(56) References Cited

OTHER PUBLICATIONS

Sukov et al., (2012). "ALK alterations in adult renal cell carcinoma: frequency, clinicopathologic features and outcome in a large series of consecutively treated patients," Mod Pathol, 25(11):1516-25.
Sun et al., (1987). "Chimeric antibody with human constant regions and mouse variable regions directed against carcinoma-associated antigen 17-1A," Proc. Natl. Acad. Sci. USA, 84(1):214-218.
Surks et al., (2003). "Myosin phosphatase-Rho interacting protein. A new member of the myosin phosphatase complex that directly binds RhoA," J Biol Chem, 278:51484-51493.
Szabo et al., (1995). "Surface plasmon resonance and its use in biomolecular interaction analysis (BIA)," Curr. Opin. Struct. Biol., 5(5):699-705.
Szperl et al., (2011). "Functional characterization of mutations in the myosin Vb gene associate d with microvillus inclusion disease," Journal of pediatric gastroenterology and nutrition, 52(3):307-13.
Takahashi et al., (1985). "Activation of a novel human transforming gene, ret, by DNA rearrangement," Cell, 42(2):581-8.
Takeda et al., (2012). "Clinical outcome for EML4-ALK-positive patients 20 with advanced non-small-cell lung cancer treated with first-line platinum-based chemotherapy," Ann Oncol, 23(11):2931-6.
Takeuchi et al., (2012). "RET, ROS1 and ALK fusions in lung cancer," Nat Med, 18:378-381.
Tewhey et al., (2009). "Microdroplet-based PCR enrichment for large-scale targeted sequencing," Nature Biotech., 27(11):1025-1031.
Thien et al., (1997). "EGF receptor binding and transformation by v-cbl is ablated by the introduction of a loss-of-function mutation from the Caenorhabditis elegans sli-1 gene," Oncogene, 14(18):2239-49.
Thien et al., (1997). "Tyrosine kinase activity of the EGF receptor is enhanced by the expression of oncogenic 70Z-Cbl," Oncogene, 15(24):2909-19.
Tomlins et al., (2005). "Recurrent fusion of TMPRSS2 and 15 ETS transcription factor genes in prostate cancer," Science, 310(5748):644-8.
Tomlins et al., (2008). "Role of the TMPRSS2-ERG gene fusion in prostate cancer," Neoplasia, 10(2):177-88.
Tomlinson et al., (2009). "Fibroblast growth factor receptor 1 promotes proliferation and survival via activation of the mitogen-activated protein kinase pathway in bladder cancer," Cancer Res, 69(11):4613-20.
Tomlinson et al., (2012). "FGFR1-induced epithelial to mesenchymal transition through MAPK/PLC/COX-2-mediated mechanisms," PLoS One, 7(6):e38972, 10 pages.
Toulme, (2001). "New candidates for true antisense," Nature Biotech., 19:17-18.
Trapnell et al., (2009). "How to map billions of short reads onto genomes," Nature Biotech., 27(5):455-457.
Traunecker et al., (1991). "Bispecific single chain molecules (Janusins) target cytotoxic lymphocytes on HIV infected cells," EMBO J., 10(12):3655-3659.
Turner et al., (2009). "Massively parallel exon capture and library-free resequencing across 16 genomes," Nature Methods, 6(5):315-316.
Tutt et al., (1991). "Trispecific F(ab')3 derivatives that use cooperative signaling via the TCR/CD3 complex and CD2 to activate and redirect resting cytotoxic T cells," J. Immunol., 147(1):60-69.
Van der Krol et al., (1988). "Modulation of eukaryotic gene expression by complementary RNA or DNA sequences," Biotechniques, 6(10):958-976.
Van Dijk et al., (2001). "Human antibodies as next generation therapeutics," Curr. Opin. Pharmacol., 5(4):368-374.
Van Hattem et al., (2011). "Histologic variations in juvenile polyp phenotype correlate with genetic defect underlying juvenile polyposis," Am J Surg Path, 35(4):530-6, 16 pages.
Van Oers et al., (2009). "FGFR3 mutations indicate better survival in invasive upper urinary tract and bladder tumours," Eur Urol, 55(3):650-7.
Verhoeyan et al., (1988). "Reshaping human antibodies: grafting an antilysozyme activity," Science, 239(4847):1534-1536.
Vollmers et al., (2005). "Death by stress: natural IgM-induced apoptosis," Methods and Findings in Experimental and Clinical Pharmacology, 27(3):185-191.
Vollmers et al., (2005). "The 'early birds': natural IgM antibodies and immune surveillance," Histology and Histopathology, 20(3):927-937.
Wada et al., (1992). "Codon usage tabulated from the GenBank genetic sequence data," Nucleic Acids Res., 20:2111-2118.
Wan et al., (2004). "Mechanism of activation of the RAF-ERK signaling pathway by oncogenic mutations of B-RAF," Cell, 116(6):855-67.
Wang et al., (2019). "Durable Clinical Response to Crizotinib in IRF2BP2-NTRK1 Non-small-cell Lung Cancer," Clin Lung Cancer, 20(3):e233-e237.
Warren et al., (2007). "Assembling millions of short DNA sequences using SSAKE," Bioinformatics, 23(4):500-501.
Wasag et al., (2011). "The kinase inhibitor TKI258 is active against the novel CUX1-FGFR1 fusion detected in a patient with T-lymphoblastic leukemia/lymphoma and t(7;8)(q22;p. 11)," Haematologica, 96(6):922-6.
Wells et al., (2010). "Abstract 5503: Vandetanib (VAN) in locally advanced or metastatic medullary thyroid cancer (MTC): A randomized, double-blind phase III trial (ZETA)," J Clinical Oncology, 28(15 Suppl), 3 pages.
Werynska et al., (2009). "Role of lymphangiogenesis in lung cancer," Folia Histochem Cytobiol, 47(3):333-42.
Wheeless et al., (1994). "Bladder irrigation specimens assayed by fluorescence in situ hybridization to interphase nuclei," Cytometry, 17(4):319-326.
Winoto et al., (1989). "A novel, inducible and T cell-specific enhancer located at the 3' end of the T cell receptor alpha locus," EMBO J., 8(3):729-733.
Winter et al., (1994). "Making antibodies by phage display technology," Ann. Rev. Immunol., 12:433-455.
Wood et al., (1985). "The synthesis and in vivo assembly of functional antibodies in yeast," Nature, 314(6010):446-449.
Wooten et al., (2001). "The atypical protein kinase C-interacting protein p62 is a scaffold for NF-kappaB activation by nerve growth factor," J Biol Chem, 276(11):7709-12.
Wright et al., (1997). "Effect of glycosylation on antibody function: implications for genetic engineering," Trends Biotechnol., 15(1):26-32.
Wu et al., (1989). "The ligation amplification reaction (LAR)—amplification of specific DNA sequences using sequential rounds of template-dependent ligation," Genomics, 4(4):560-569.
Wu, (2005). "Urothelial tumorigenesis: a tale of divergent pathways," Nat Rev Cancer, 5(9):713-25.
Yamane-Ohnuki et al., (2004). "Establishment of FUT8 knockout Chinese hamster ovary cells: an ideal host cell line for producing completely defucosylated antibodies with enhanced antibody-dependent cellular cytotoxicity," Biotechnol Bioeng., 87(5):614-622.
Yamayoshi et al., (2004). "Expression of keratinocyte growth factor/fibroblast growth factor-7 and its receptor in human lung cancer: correlation with tumour proliferative activity and patient prognosis," J Pathol, 204(1):110-8.
Yang et al., (2002). "Short RNA duplexes produced by hydrolysis with *Escherichia coli* RNase III mediate effective RNA interference in mammalian cells," Proc. Natl. Acad. Sci. USA, 99(15):9942-9947.
Yuan et al., (2008). "Yes-associated protein (YAP) functions as a tumor suppressor in breast," Cell death and differentiation, 15(11):1752-9.
Zerbino et al., (2008). "Velvet: algorithms for de novo short read assembly using de Bruijn graphs," Genome Res., 18(5):821-829.
Zhan et al., (2009). "Prognostic value of vascular endothelial growth factor expression in patients with lung cancer: a systematic review with meta-analysis," J Thorac Oncol., 4(9):1094-103.
Zhang et al., (2009). "Oncogenic Adenomatous polyposis coli mutants impair the mitotic checkpoint through direct interaction with Mad2," Molecular biology of the cell, 20(9):2381-8.

(56) References Cited

OTHER PUBLICATIONS

Zhong et al., (1999). "A RA-dependent, tumour-growth suppressive transcription complex is the target of the PML-RARalpha and T18 oncoproteins," Nat Genet, 23(3):287-95.
Zhou et al., (2009). "Novel mutant-selective EGFR kinase inhibitors against EGFR T790M," Nature, 462:1070-1074, 12 pages.
Zhou et al., (2018). "A primary undifferentiated pleomorphic sarcoma of the lumbosacral region harboring a LMNA-NTRK1 gene fusion with durable clinical response to crizotinib: a case report," BMC Cancer, 18(1):842.
Ziegler et al., (2018). "Brief Report: Potent clinical and radiological response to larotrectinib in TRK fusion-driven high-grade glioma," Br J Cancer, 119(6):693-696.
Zon (1988). "Oligonucleotide analogues as potential chemotherapeutic agents," Pharm. Res., 5(9):539-549.
Zuckermann et al., (1994). "Discovery of nanomolar ligands for 7-transmembrane G-protein-coupled receptors from a diverse N-(substituted)glycine peptoid library," J Med Chem., 37(17):2678-2685.
Cole et al., (1985). "The EBV-Hybridoma Technique and its Application to Human Lung Cancer," Monoclonal Antibodies and Cancer Therapy, pp. 77-96.
Gottesman, (1990). "Minimizing Proteolysis in *Escherichia coli*: Genetic Solutions," Methods in Enzymology, 185, pp. 119-128.
Morris et al., (1994). "Fusion of a kinase gene, ALK, to a nucleolar protein gene, NPM, in non-Hodgkin's lymphoma," Science, 263(5151):1281-4. Abstract Only.
Patel et al., (2010). "Abstract: ACTB-1003: An oral kinase inhibitor targeting cancer mutations (FGFR), angiogenesis (VEGFR2, TEK), and induction of apoptosis (RSK and p70S6K)," Journal of Clinical Oncology, ASCO Annual Meeting Abstracts, 28(15 suppl):e13665, 3 pages.
Woolf et al., (1995). "Towards the therapeutic editing of mutated RNA sequences," PNAS USA, 92:8298-8302.
Zhao et al., (2011). "A novel, selective inhibitor of fibroblast growth factor receptors that shows a potent broad spectrum of antitumor activity in several tumor xenograft models," Mol Cancer Ther., 10(11):2200-10.
Kim et al., (2003). "SAM domains: uniform structure, diversity of function," Trends Biochem. Sci., 28(12):625-628.
Kolinsky et al., (2011). "Preclinical evaluation of the novel multi-targeted agent R1530," Cancer Chemother Pharmacol., 68(6):1585-94.
Alonso et al, (1994). "Biodegradable microspheres as controlled-release tetanus toxoid delivery systems," Vaccine, 12(4):299-306.
Eldridge et al., (1991). "Biodegradable microspheres as a vaccine delivery system," Molec. Immunol., 28:287-294.
Emens, (2008). "Cancer vaccines: on the threshold of success," Expert Opin Emerg Drugs, 13(2):295-308, 22 pages.
Frampton et al., (2013). "Development and validation of a clinical cancer genomic profiling test based on massively parallel DNA sequencing," Nature Biotechnology, 31(11):1023-1031.
Hu et al., (1998). "The immunostimulating complex (ISCOM) is an efficient mucosal delivery system for respiratory syncytial virus (RSV) envelope antigens inducing high local and systemic antibody responses," Clin. Exp. Immunol., 113:235-243.
Jones et al., (1995). "Protection of mice from Bordetella pertussis respiratory infection using microencapsulated pertussis fimbriae," Vaccine, 13:675-681.
Pardoll, (2012). "The blockade of immune checkpoints in cancer immunotherapy," Nat Rev Cancer, 12(4):252-64.
Pietrantonio et al., (2017). "ALK, ROS1, and NTRK Rearrangements in Metastatic Colorectal Cancer," J Natl Cancer Inst, 109(12), 10 pages.
Ross et al., (2017). "ALK Fusions in a Wide Variety of Tumor Types Respond to Anti-ALK Targeted Therapy," Oncologist, 22(12):1444-1450.
Takahashi et al., (1990). "Induction of CD8+ cytotoxic T cells by immunization with purified HIV-1 envelope protein in ISCOMs," Nature, 344:873-875.
Tam, (1988). "Synthetic peptide vaccine design: synthesis and properties of a high-density multiple antigenic peptide system," Proc. Natl Acad. Sci. U.S.A., 85:5409-5413.
Tam, (1996). "Recent advances in multiple antigen peptides," J. Immunol. Methods, 196:17-32.
Vitiello et al., (1995). "Development of a lipopeptide-based therapeutic vaccine to treat chronic HBV infection. I. Induction of a primary cytotoxic T lymphocyte response in humans," J. Clin. Invest., 95:341-9.
Wang et al., (2020). "Emerging Roles of ALK in Immunity and Insights for Immunotherapy," Cancers, 12(2):426, 5 pages.
Yamada et al., (2013). "Next-generation peptide vaccines for advanced cancer," Cancer Sci, 104:14-21.
Yankauckas et al., (1993). "Long-Term Anti-Nucleoprotein Cellular and Humoral Immunity Is Induced by Intramuscular Injection of Plasmid DNA Containing NP Gene," DNA Cell Biol., 12:771-776.

* cited by examiner

| Fusion | Cancer type | Breakpoint 1 | Breakpoint 2 | Rearrangement |
|---|---|---|---|---|
| MEX3A-NTRK1 | Ovarian carcinosarcoma | 156843777-156843890 on Chromosome 1 | 156051070-156051319 on Chromosome 1 | Inversion |
| CARM1-NTRK3 | Vaginal melanoma | 88799136-88799434 on Chromosome 15 | 11019501-11019751 on Chromosome 19 | Chr15:19 translocation |

FIG. 1A

| Fusion | 5' Transcript ID | Last exon of 5' transcript | 3' Transcript ID | First exon of 3' transcript |
|---|---|---|---|---|
| MEX3A-NTRK1 | NM_001093725 | exon 1 | NM_002529 | exon 9 |
| CARM1-NTRK3 | NM_199141.2 | exon 3 | NM_002530 | exon 3 |

FIG. 1B

| Fusion/Component | Type of Sequence Nt (nucleotide) Aa (amino acid) | SEQ ID NO | FIGURE |
|---|---|---|---|
| **MEX3A-NTRK1** | | | |
| 5' partner | Nt | 1 | 2 |
| 5' partner | Aa | 2 | 3 |
| 3' partner | Nt | 3 | 4 |
| 3' partner | Aa | 4 | 5 |
| Fusion | Nt | 5 | 6 |
| Fusion | Aa | 6 | 7 |
| **CARM1-NTRK3** | | | |
| 5' partner | Nt | 7 | 8 |
| 5' partner | Aa | 8 | 9 |
| 3' partner | Nt | 9 | 10 |
| 3' partner | Aa | 10 | 11 |
| Fusion | Nt | 11 | 12 |
| Fusion | Aa | 12 | 13 |

FIG. 1C

```
   1 aaaagagttt gagcgctgga aggggctggg ctctattggg ggccactgag cgccgctccc
  61 ggactggggc tcggtgcggg agcctaacgg gggcgcctgg acagcggggg ctagagactc
 121 ccaggtccga ggcgggaggg gtgggggcag agatcctgca gccccccgcc ccccgtcacc
 181 cccggagagg agaggagatc tgctttcttg gttttgcttc tctttccccc cacccccacc
 241 ccgggggctg gggcgagggg agtcgggtta cagggtgttt ggggaggggg gcttaggggg
 301 agggtctatc tttctatctc gctttcttcc cccctcccca gttctttgtt ccccccctccc
 361 cacacacccc ctcctctcct ctcccctccc ctcctctctc ctcttttccc ttccaccacc
 421 tctctctctc tctctccctc tctctctccc ccagcttttg tttcgccatg cctagtctag
 481 tggtatctgg aataatggaa agaaatgggg gctttggaga actaggatgt ttcgggggaa
 541 gcgctaagga ccgagggctg ctggaagacg agcgcgccct tcagctggct ctcgatcaac
 601 tctgcctcct gggtttgggg gagccccccg cccccacggc gggcgaggac gggggaggtg
 661 ggggggggcgg cgcccccgcg cagccggccg cccccccgca gccggccccg ccgccgccgc
 721 ccgcggcgcc cccggccgcc ccgacggcgg cccccgcagc gcagacgccc cagcccccca
 781 ccgcccccaa aggggcgagc gacgccaagc tctgcgctct ctacaaagag gccgagctgc
 841 gcctgaaggg cagcagcaac accacggagt gtgttcccgt gcccacctcc gagcacgtgg
 901 ccgagatcgt gggcaggcaa ggctgcaaga ttaaggcctt gagggccaag accaacacct
 961 acatcaagac accggtgagg ggcgaggaac cagtgttcat ggtgacaggg cgacgggagg
1021 acgtggccac agcccggcgg gaaatcatct cagcagcgga gcacttctcc atgatccgtg
1081 cctcccgcaa caagtcaggc gccgcctttg gtgtggctcc tgctctgccc ggccaggtga
1141 ccatccgtgt gcgggtgccc taccgcgtgg tggggctggt ggtgggcccc aaagggggcaa
1201 ccatcaagcg catccagcag caaaccaaca catacattat cacaccaagc cgtgaccgcg
1261 accccgtgtt cgagatcacg ggtgccccag gcaacgtgga gcgtgcgcgc gaggagatcg
1321 agacgcacat cgcggtgcgc actggcaaga tcctcgagta caacaatgaa aacgacttcc
1381 tggcggggag ccccgacgca gcaatcgata gccgctactc cgacgcctgg cgggtgcacc
1441 agcccggctg caagcccctc tccaccttcc ggcagaacag cctgggctgc atcggcgagt
1501 gcggagtgga ctctggcttt gaggccccac gcctgggtga gcagggcggg gactttggct
1561 acggcgggta cctctttccg ggctatggcg tgggcaagca ggatgtgtac tacggcgtgg
1621 ccgagactag ccccccgctg tgggcgggcc aggagaacgc cacgcccacc tccgtgctct
1681 tctcctctgc ctcctcctcc tcctcctctt ccgccaaggc ccgcgctggg cccccgggcg
1741 cacaccgctc ccctgccact tccgcgggac ccgagctggc cggactcccg aggcgccccc
1801 cgggagagcc gctccagggc ttctctaaac ttggtggggg cggcctgcgg agccccggcg
1861 gcgggcggga ttgcatggtc tgctttgaga gcgaagtgac tgccgccctt gtgccctgcg
1921 gacacaacct gttctgcatg gagtgtgcag tacgcatctg cgagaggacg gacccagagt
1981 gtcccgtctg ccacatcaca gccacgcaag ccatccgaat attctcctaa gccccgtgcc
2041 ccatgcctcc ggggcccact ccactgggcc caccctggac ctgttttcca ctaaagcctt
2101 ttggaaagcg gtgatttgag gggcaaggtg cttagagata ctcgctcgct ggggaagggg
2161 ggagggaggc agtggtggct ggagggtgcg ccactttcag agcctctggt caccctgtcc
2221 tggaaagatt gggagggggc cagactgaaa attttactag agttacaact ctgatacctc
2281 aacacaccct taaatctgga agcagctaag agaaactttt gttttgccag aggtggccac
2341 taaggcattc tgacgccctc tgcccacctc ccccgctgtg tgtcactcca ccccttcttc
2401 cgaggagggg gtgggtaaaa gggagaggga gaattaccac ctgtatctag aggtgctctt
2461 tgcaatccct aagccctctg gtcctgacct ccgacctcct aacatgaccc tttacctccc
2521 accccacccc catatcctgt ttgggaaact gtcaccagtt tccagcagtg taagggagtt
2581 ggagtcctat cagaagttgc atagatcttc taggggttgg ggagagaagc atgtcaatcg
2641 tttctgtggc tgaaaggctc agaagccatc tgtccccaca aagctgggct agaggaatct
2701 ggagaggagt cctcctctct gcccctgtcc cctgcagtgt ttcccttcac tctctccgcc
2761 tatcttccct tcctttggga tcttcccttt cctcaactct ttcctttccc tccagctctt
2821 tgctttgctt tcttttggtg gctgtcactc ccagctctgt cttgttcctt gtctttgtct
2881 ttcttccctt ccccctgccc ctgcccctac cagcccagct ttggggacac catccttctg
2941 gggagaagta gggggaggaa tatttggatg gtccctccat tcctcttcag gcatctggag
3001 gccctctccc ccactcctcc aaagaaacat ctcaaattat tgatggaatg tatccccatt
```

FIG. 2

```
3061 ctcagtgaaa atgtgaggag gggactaata ctggggtaaa gggtcaaacc cccaccttca
3121 tcactatggg cattatattt agggagtagt tcttgggctg gattttctgg ttgtggaagt
3181 gggggcgcca gagtagtgtg tctgctattt aaaggagcag gaaagggcgt gaggcaggag
3241 gagagactgg tggagggaag agctgctcct cccatgcagt gcccgactcc ctgcacccct
3301 ctcaacctga cctgaacctt tattgaatcc ttattagctt gaatccttat tagcttgaat
3361 cctccatgca aatcatggag tctgtgtccc acctgatgtg gttgaggaga agccaggtct
3421 tcaaagaggg gtcagcctgg ggcaaagcag gactgggggg aggtgggcag caggcctat
3481 tctgagaatc acatattgtt acaggccttg caccccctt gctgcttccc tcctgctcat
3541 ttggggctgc caccagctct ccaccctcct ggttccgctg gccgggccaa gagaggatgg
3601 agggatggga gtcccaggag atccttgtaa atagtggggt gggactgttc tgagtgatca
3661 cccgagcact taaagctcca gagtcccatt cttcctggat ggagcaggtg gaggtgcaga
3721 ggggatttcc tcctctcctt cctcctgtcg agaattaaca cctctccaca gccttcccct
3781 ccagaacacc agccagggag gggtggggaa ggaggtcaca gccaagaaaa ctgccctgtg
3841 acgacttccc tccttcccgc ctatgtgagc catcctgaga tgtctgtaca atagaaacca
3901 aaccaaatgg gcaccctcgg ttgccggggg gcaggtgggg agggggtgg gaagaaggga
3961 tgtctgtctg tcgtccccct cccctctcc actctttacc cacaaaggca gaagactgtt
4021 acactagggg gctcagcaaa ttcaatccca cccttaccaa ttgagccaaa cctagaaaca
4081 aacacaaaac acgaatagtg agagacaaaa tagaggagag aaagagagca tgagagggag
4141 cgagacaggc gaccaacaca gaggagagaa aacaaaaata gcaaaaaaaa aaaaaaaaag
4201 cagttcttta taatttaata ttctatttta ataaaggcgt ttattaccat ataaatgtag
4261 caaagaacct gggctaatat gaaaaaaaaa gacttttat taggtaattt attatatgaa
4321 aaggatattt tattttatga taaagtgatc cttaaaaaaa taaaaaaact ttagaaggtt
4381 tagaatatat gtagggagag aagaagaaaa aaatacattt gtattcagag ttaaatctta
4441 aaaaaaaaaa gtgtttttaa tatatgtttg ggtttacgtt gctttttcc cccactttt
4501 ttttggggag gaatgtcatt tgcttttctt gggggagcat cccggggtg aatggtggag
4561 agaggagctg ggggaacccg gtccctcctg ggacccttcc agtagattgg atttcactcc
4621 atggactcct cctcccctct cccctcccc ctcaggggag ccggcagagc caaacaaaga
4681 aagggattaa caagaaagga agaagctgta ggactaagga ctgaggatcc tggggtgtcc
4741 cccaccactt tcccctgccc tgtcgcaggg gcaagtgagg aggggaatc cagaattaag
4801 gcctagcagg cctataggaa ccctcagaga tgtgtgagat ttaagagatc tagattttt
4861 tttaaccaaa aacaagagag aaagagaaga aaaagagaaa ccgaggggtt taaaagaaaa
4921 gaatactaca aaataataat tattaataat aataattcaa atttatttca tataatccta
4981 gagagagaaa gaaacaatta ctagttactt agtagacaat attaagatag cttaaagttt
5041 agtagcattg agggcccctg ggtccagtag aatgtataaa agttgtaagg aaaagataaa
5101 tagaggaggg aagtggctga gtccaccctg agttgcccaa tcttcagata ccagggttgg
5161 atcaggttgc tagtttaaga ttgggagctt ccagtctgct ggggttgatt ctgagaatcc
5221 ttggattttt aaattgtagg acaaagaaat gaggggttca tttcccaggg tcttggaaag
5281 gatgcacact gatcatctca ataagacagg ggctgggttg ggggcagcag aggaggccaa
5341 gcacattcac ctgcacccct agtacctggg cagcccatac tccaatgtgg tatgtcccct
5401 cctggggctc ccagctcaaa ccctcccatg cctgcttccc ccaggcctaa ctgaggaagt
5461 ccttcttgaa gtgtgacctc ggtccacttc tctacagatt gatttaagag cctgggaagt
5521 cattccacaa acagacacac atgcacacac gcttctcacc ttcagagctt caagagcact
5581 gaggcgatca gtcccctacc cctgttccca tccagctttc cacttagctt tgacctccat
5641 ggcagcagta gcagtaacaa tctcagtaat tgttctttaa agctgactcg ttcttcacct
5701 acttgcaaag tgctttcttg tctcataaaa gttagattcc aagaaggact tcccacggag
5761 tggagtggaa acactgtcct tgaaggcctg ggagaaaggc atccccatgg gcacagaggc
5821 tggggaaagg cacagggact ttgggtgacc ctaaccctga ccctctgctc cagttcacct
5881 ccatctatat gtgttcaggt aggggtcatc tactgtaccc tggcctggga acacattgcc
5941 ctccccacac aaaactggag ggcttggctt ctgcgtgtga gaaatcaaca tttttaaagc
6001 acttgccttc taccaacccc agcttgcaat cactgggcct tcccctccta tccaaggggt
6061 tggagggggcc ccttggctct ccttttggca ggaggagcct gcttcattac accaatgact
6121 ctgccatccc cctccctggc cctagacccc aaacacatct ccctctaccc aatttactct
6181 tctcgcccca cctagggaca gattccccct gctcttttg tcctagaaac cccgctagtt
6241 tgggatggta gcgtctgggg tggggagggc ttccccttcc ccactcgagg gtgcgggtgg
6301 ggaagggggg gtgggtggag acagccctgg ggcagggagg atggtctctc cactgtagaa
6361 agtagagtag gattgtggtc agacttaatt tgaggcatct agtgaagaca cgtacaaatc
6421 caccaaggaa aaagatttca aaagcaaaat aaaagcggga aataaaacag acccaagaat
                                                    (SEQ ID NO: 1)
```

FIG. 2 (cont'd.)

MPSLVVSGIMERNGGFGELGCFGGSAKDRGLLEDERALQLALDQLCLLGLGEPPAPTAGEDGGGGGGGAP
AQPAAPPQPAPPPPPAAPPAAPTAAPAAQTPQPPTAPKGASDAKLCALYKEAELRLKGSSNTTECVPVPT
SEHVAEIVGRQGCKIKALRAKTNTYIKTPVRGEEPVFMVTGRREDVATARREIISAAEHFSMIRASRNKS
GAAFGVAPALPGQVTIRVRVPYRVVGLVVGPKGATIKRIQQQTNTYIITPSRDRDPVFEITGAPGNVERA
REEIETHIAVRTGKILEYNNENDFLAGSPDAAIDSRYSDAWRVHQPGCKPLSTFRQNSLGCIGECGVDSG
FEAPRLGEQGGDFGYGGYLFPGYGVGKQDVYYGVAETSPPLWAGQENATPTSVLFSSASSSSSSSAKARA
GPPGAHRSPATSAGPELAGLPRRPPGEPLQGFSKLGGGGLRSPGGGRDCMVCFESEVTAALVPCGHNLFC
MECAVRICERTDPECPVCHITATQAIRIFS(SEQ ID NO: 2)

FIG. 3

1 tgcagctggg agcgcacaga cggctgcccc gcctgagcga ggcgggcgcc gccgcg*atg*c
61 tgcgaggcgg acggcgcggg cagcttggct ggcacagctg ggctgcgggg ccgggcagcc
121 tgctggcttg gctgatactg gcatctgcgg gcgccgcacc ctgccccgat gcctgctgcc
181 cccacggctc ctcgggactg cgatgcaccc gggatggggc cctggatagc ctccaccacc
241 tgcccggcgc agagaacctg actgagctct acatcgagaa ccagcagcat ctgcagcatc
301 tggagctccg tgatctgagg ggcctggggg agctgagaaa cctcaccatc gtgaagagtg
361 gtctccgttt cgtggcgcca gatgccttcc atttcactcc tcggctcagt cgcctgaatc
421 tctccttcaa cgctctggag tctctctcct ggaaaactgt gcagggcctc tccttacagg
481 aactggtcct gtcggggaac cctctgcact gttcttgtgc cctgcgctgg ctacagcgct
541 gggaggagga gggactgggc ggagtgcctg aacagaagct gcagtgtcat gggcaagggc
601 ccctggccca catgcccaat gccagctgtg gtgtgcccac gctgaaggtc caggtgccca
661 atgcctcggt ggatgtgggg gacgacgtgc tgctgcggtg ccaggtggag gggcggggcc
721 tggagcaggc cggctggatc ctcacagagc tggagcagtc agccacggtg atgaaatctg
781 ggggtctgcc atccctgggg ctgaccctgg ccaatgtcac cagtgacctc aacaggaaga
841 acgtgacgtg ctgggcagag aacgatgtgg gccgggcaga ggtctctgtt caggtcaacg
901 tctccttccc ggccagtgtg cagctgcaca cggcggtgga gatgcaccac tggtgcatcc
961 ccttctctgt ggatgggcag ccggcaccgt ctctgcgctg gctcttcaat ggctccgtgc
1021 tcaatgagac cagcttcatc ttcactgagt tcctggagcc ggcagccaat gagaccgtgc
1081 ggcacgggtg tctgcgcctc aaccagccca cccacgtcaa caacggcaac tacacgctgc
1141 tggctgccaa ccccttcggc caggcctccg cctccatcat ggctgccttc atggacaacc
1201 ctttcgagtt caaccccgag gaccccatcc ctgtctcctt ctcgccggtg gacactaaca
1261 gcacatctgg agacccggtg gagaagaagg acgaaacacc ttttggggtc tcggtggctg
1321 tgggcctggc cgtctttgcc tgcctcttcc tttctacgct gctccttgtg ctcaacaaat
1381 gtggacggag aaacaagttt gggatcaacc gcccggctgt gctggctcca gaggatgggc
1441 tggccatgtc cctgcatttc atgacattgg gtggcagctc cctgtccccc accgagggca
1501 aaggctctgg gctccaaggc cacatcatcg agaacccaca atacttcagt gatgcctgtg
1561 ttcaccacat caagcgccgg gacatcgtgc tcaagtggga gctgggggag ggcgcctttg
1621 ggaaggtctt ccttgctgag tgccacaacc tcctgcctga gcaggacaag atgctggtgg
1681 ctgtcaaggc actgaaggag gcgtccgaga gtgctcggca ggacttccag cgtgaggctg
1741 agctgctcac catgctgcag caccagcaca tcgtgcgctt cttcggcgtc tgcaccgagg
1801 gccgcccccct gctcatggtc tttgagtata tgcggcacgg ggacctcaac cgcttcctcc
1861 gatcccatgg acctgatgcc aagctgctgg ctggtgggga ggatgtggct ccaggccccc
1921 tgggtctggg gcagctgctg gccgtggcta gccaggtcgc tgcggggatg gtgtacctgg
1981 cgggtctgca ttttgtgcac cgggacctgg ccacacgcaa ctgtctagtg ggccagggac
2041 tggtggtcaa gattggtgat tttggcatga gcagggatat ctacagcacc gactattacc
2101 gtgtgggagg ccgcaccatg ctgcccattc gctggatgcc gcccgagagc atcctgtacc
2161 gtaagttcac caccgagagc gacgtgtgga gcttcggcgt ggtgctctgg gagatcttca
2221 cctacggcaa gcagccctgg taccagctct ccaacacgga ggcaatcgac tgcatcacgc
2281 agggacgtga gttggagcgg ccacgtgcct gcccaccaga ggtctacgcc atcatgcggg
2341 gctgctggca gcgggagccc cagcaacgcc acagcatcaa ggatgtgcac gcccggctgc
2401 aagccctggc ccaggcacct cctgtctacc tggatgtcct gggc*tag*ggg gccggcccag
2461 gggctgggag tggttagccg gaatactggg gcctgccctc agcatccccc atagctccca
2521 gcagccccag ggtgatctca aagtatctaa ttcaccctca gcatgtggga agggacaggt
2581 gggggctggg agtagaggat gttcctgctt ctctaggcaa ggtcccgtca tagcaattat
2641 atttattatc ccttgaaaaa aaa(SEQ ID NO: 3)

FIG. 4

MLRGGRRGQLGWHSWAAGPGSLLAWLILASAGAAPCPDACCPHGSSGLRCTRDGALDSLHHLPGAENLTE
LYIENQQHLQHLELRDLRGLGELRNLTIVKSGLRFVAPDAFHFTPRLSRLNLSFNALESLSWKTVQGLSL
QELVLSGNPLHCSCALRWLQRWEEEGLGGVPEQKLQCHGQGPLAHMPNASCGVPTLKVQVPNASVDVGDD
VLLRCQVEGRGLEQAGWILTELEQSATVMKSGGLPSLGLTLANVTSDLNRKNVTCWAENDVGRAEVSVQV
NVSFPASVQLHTAVEMHHWCIPFSVDGQPAPSLRWLFNGSVLNETSFIFTEFLEPAANETVRHGCLRLNQ
PTHVNNGNYTLLAANPFGQASASIMAAFMDNPFEFNPEDPIPVSFSPVDTNSTSGDPVEKKDETPFGVSV
AVGLAVFACLFLSTLLLVLNKCGRRNKFGINRPAVLAPEDGLAMSLHFMTLGGSSLSPTEGKGSGLQGHI
IENPQYFSDACVHHIKRRDIVLKWELGEGAFGKVFLAECHNLLPEQDKMLVAVKALKEASESARQDFQRE
AELLTMLQHQHIVRFFGVCTEGRPLLMVFEYMRHGDLNRFLRSHGPDAKLLAGGEDVAPGPLGLGQLLAV
ASQVAAGMVYLAGLHFVHRDLATRNCLVGQGLVVKIGDFGMSRDIYSTDYYRVGGRTMLPIRWMPPESIL
YRKFTTESDVWSFGVVLWEIFTYGKQPWYQLSNTEAIDCITQGRELERPRACPPEVYAIMRGCWQREPQQ
RHSIKDVHARLQALAQAPPVYLDVLG (SEQ ID NO: 4)

FIG. 5

*ATG*CCTAGTCTAGTGGTATCTGGAATAATGGAAAGAAATGGGGGCTTT
GGAGAACTAGGATGTTTCGGGGGAAGCGCTAAGGACCGAGGGCTGC
TGGAAGACGAGCGCGCCCTTCAGCTGGCTCTCGATCAACTCTGCCTC
CTGGGTTTGGGGGAGCCCCCCGCCCCCACGGCGGGCGAGGACGGGG
GAGGTGGGGGGGGCGGCGCCCCCGCGCAGCCGGCCGCCCCCCCGCA
GCCGGCCCCGCCGCCGCCGCCCGCGGCGCCCCCGGCCGCCCCGACG
GCGGCCCCCGCAGCGCAGACGCCCCAGCCCCCCACCGCCCCCAAAG
GGGCGAGCGACGCCAAGCTCTGCGCTCTCTACAAAGAGGCCGAGCT
GCGCCTGAAGGGCAGCAGCAACACCACGGAGTGTGTTCCCGTGCCC
ACCTCCGAGCACGTGGCCGAGATCGTGGGCAGGCAAGTCTCCTTCTC
GCCGGTGGACACTAACAGCACATCTGGAGACCCGGTGGAGAAGAAG
GACGAAACACCTTTTGGGGTCTCGGTGGCTGTGGGCCTGGCCGTCTT
TGCCTGCCTCTTCCTTTCTACGCTGCTCCTTGTGCTCAACAAATGTGG
ACGGAGAAACAAGTTTGGGATCAACCGCCCGGCTGTGCTGGCTCCA
GAGGATGGGCTGGCCATGTCCCTGCATTTCATGACATTGGGTGGCAG
CTCCCTGTCCCCCACCGAGGGCAAAGGCTCTGGGCTCCAAGGCCAC
ATCATCGAGAACCCACAATACTTCAGTGATGCCTGTGTTCACCACATC
AAGCGCCGGGACATCGTGCTCAAGTGGGAGCTGGGGGAGGGCGCCT
TTGGGAAGGTCTTCCTTGCTGAGTGCCACAACCTCCTGCCTGAGCAG
GACAAGATGCTGGTGGCTGTCAAGGCACTGAAGGAGGCGTCCGAGA
GTGCTCGGCAGGACTTCCAGCGTGAGGCTGAGCTGCTCACCATGCTG
CAGCACCAGCACATCGTGCGCTTCTTCGGCGTCTGCACCGAGGGCCG
CCCCCTGCTCATGGTCTTTGAGTATATGCGGCACGGGGACCTCAACCG
CTTCCTCCGATCCCATGGACCTGATGCCAAGCTGCTGGCTGGTGGGG
AGGATGTGGCTCCAGGCCCCCTGGGTCTGGGGCAGCTGCTGGCCGTG
GCTAGCCAGGTCGCTGCGGGGATGGTGTACCTGGCGGGTCTGCATTT
TGTGCACCGGGACCTGGCCACACGCAACTGTCTAGTGGGCCAGGGA
CTGGTGGTCAAGATTGGTGATTTTGGCATGAGCAGGGATATCTACAGC
ACCGACTATTACCGTGTGGGAGGCCGCACCATGCTGCCCATTCGCTG
GATGCCGCCCGAGAGCATCCTGTACCGTAAGTTCACCACCGAGAGCG
ACGTGTGGAGCTTCGGCGTGGTGCTCTGGGAGATCTTCACCTACGGC
AAGCAGCCCTGGTACCAGCTCTCCAACACGGAGGCAATCGACTGCAT
CACGCAGGGACGTGAGTTGGAGCGGCCACGTGCCTGCCCACCAGAG
GTCTACGCCATCATGCGGGGCTGCTGGCAGCGGGAGCCCCAGCAACG
CCACAGCATCAAGGATGTGCACGCCCGGCTGCAAGCCCTGGCCCAG
GCACCTCCTGTCTACCTGGATGTCCTGGGCTAG (SEQ ID NO: 5)

FIG. 6

MPSLVVSGIMERNGGFGELGCFGGSAKDRGLL
EDERALQLALDQLCLLGLGEPPAPTAGEDGGG
GGGGAPAQPAAPPQPAPPPPPAAPPAAPTAAPA
AQTPQPPTAPKGASDAKLCALYKEAELRLKGS
SNTTECVPVPTSEHVAEIVGRQ*L*SFSPVDTNSTS
GDPVEKKDETPFGVSVAVGLAVFACLFLSTLLL
VLNKCGRRNKFGINRPAVLAPEDGLAMSLHFM
TLGGSSLSPTEGKGSGLQGHIIENPQYFSDACV
HHIKRRDIVLKWELGEGAFGKVFLAECHNLLP
EQDKMLVAVKALKEASESARQDFQREAELLTM
LQHQHIVRFFGVCTEGRPLLMVFEYMRHGDL
NRFLRSHGPDAKLLAGGEDVAPGPLGLGQLLA
VASQVAAGMVYLAGLHFVHRDLATRNCLVGQ
GLVVKIGDFGMSRDIYSTDYYRVGGRTMLPIR
WMPPESILYRKFTTESDVWSFGVVLWEIFTYG
KQPWYQLSNTEAIDCITQGRELERPRACPPEVY
AIMRGCWQREPQQRHSIKDVHARLQALAQAP
PVYLDVLG (SEQ ID NO: 6)

FIG. 7

1 ctcggcctgc acggcggctg cggcggcggt agcggcagcg gcggcggcgg cggcggcggc
61 ggcggcggcg gcggcggcgg cggcggcagc ggcggcggcc tgggcccggg cgcagcggcg
121 gcggcggcgg ggcctggagc cggatctaag *atg*gcagcgg cggcggcggc ggtggggccg
181 ggcgcgggcg gcgcggggtc ggcggtcccg ggcggcgcgg ggccctgcgc taccgtgtcg
241 gtgttccccg gcgcccgcct cctcaccatc ggcgacgcga acggcgagat ccagcggcac
301 gcggagcagc aggcgctgcg cctcgaggtg cgcgccggcc cggactcggc gggcatcgcc
361 ctctacagcc atgaagatgt gtgtgtcttt aagtgctcag tgtcccgaga gacagagtgc
421 agccgtgtgg gcaagcagtc cttcatcatc accctgggct gcaacagcgt cctcatccag
481 ttcgccacac ccaacgattt ctgttccttc tacaacatcc tgaaaacctg ccggggccac
541 accctggagc ggtctgtgtt cagcgagcgg acggaggagt cttctgccgt gcagtacttc
601 cagttttatg gctacctgtc ccagcagcag aacatgatgc aggactacgt gcggacaggc
661 acctaccagc gcgccatcct gcaaaaccac accgacttca aggacaagat cgttcttgat
721 gttggctgtg gctctgggat cctgtcgttt tttgccgccc aagctggagc acggaaaatc
781 tacgcggtgg aggccagcac catggcccag cacgctgagg tcttggtgaa gagtaacaac
841 ctgacggacc gcatcgtggt catcccgggc aaggtggagg aggtgtcact ccccgagcag
901 gtggacatca tcatctcgga gcccatgggc tacatgctct tcaacgagcg catgctggag
961 agctacctcc acgccaagaa gtacctgaag cccagcggaa acatgtttcc taccattggt
1021 gacgtccacc ttgcaccctt cacggatgaa cagctctaca tggagcagtt caccaaggcc
1081 aacttctggt accagccatc tttccatgga gtggacctgt cggccctccg aggtgccgcg
1141 gtggatgagt atttccggca gcctgtggtg gacacatttg acatccggat cctgatggcc
1201 aagtctgtca agtacacggt gaacttctta gaagccaaag aaggagattt gcacaggata
1261 gaaatcccat tcaaattcca catgctgcat tcagggctgg tccacggcct ggctttctgg
1321 tttgacgttg ctttcatcgg ctccataatg accgtgtggc tgtccacagc cccgacagag
1381 cccctgaccc actggtacca ggtgcggtgc ctgttccagt caccactgtt cgccaaggca
1441 ggggacacgc tctcagggac atgtctgctt attgccaaca aaagacagag ctacgacatc
1501 agtattgtgg cccaggtgga ccagaccggc tccaagtcca gtaacctcct ggatctgaaa
1561 aaccccttct ttagatacac gggcacaacg ccctcacccc cacccggctc ccactacaca
1621 tctccctcgg aaaacatgtg gaacacgggc agcacctaca acctcagcag cgggatggcc
1681 gtggcaggga tgccgaccgc ctatgacttg agcagtgtta ttgccagtgg ctccagcgtg
1741 ggccacaaca acctgattcc tttagccaac acggggattg tcaatcacac ccactcccgg
1801 atgggctcca taatgagcac ggggattgtc caagggtcct ccggcgccca gggcagtggt
1861 ggtggcagca cgagtgccca ctatgcagtc aacagccagt tcaccatggg cggccccgcc
1921 atctccatgg cgtcgcccat gtccatcccg accaacacca tgcactacgg gagc*tag*ggg
1981 cccgccccgc ggactgacag caccaggaaa ccaaatgatg tccctgcccg ccgcccccgc
2041 cgggcggctt tccccccttgt actggagaag ctcgaacacc cggtcacagc tctctttgct
2101 atgggaactg ggacactttt ttacacgatg ttgccgccgt ccccacccta acccccacct
2161 cccggccctg agcgtgtgtc gctgccatat tttacacaaa atcatgttgt gggagccctc
2221 gtccccccctc ctgcccgctc taccctgacc tgggcttgtc atctgctgga acaggcgcca
2281 tggggcctgc cagccctgcc tgccaggtcc cttagcacct gtccccctgc ctgtctccag
2341 tgggaaggta gcctggccag gcggggcctc cccttcgacg accaggcctc ggtcacaacg
2401 gacgtgacat gctgcttttt ttaattttat tttttttatga aaagaaccag tgtcaatccg
2461 cagaccctct gtgaagccag gccggccggg ccgagccagc agcccctctc cctagactca
2521 gaggcgccgc ggggaggggt ggccccgccg aggcttcagg ggccccctcc ccaccaaagg
2581 gttcacctca cacttgaatg tacaacccac ccactgtcg ggaaggcctc cgtcctcggc
2641 ccctgcctct tgctgctgtc ctgtccccga gcccctgcag gtcccccccc gcccccccac
2701 tcaagagtta gagcaggtgg ctgcaggcct tgggcccgga gggaaggcca ctgccggcca
2761 cttggggcag acacagacac ctcaaggatc tgtcacggaa ggcgtccttt ttccttgtag
2821 ctaacgttag gcctgagtag ctcccctcca tccttgtaga cgctccagtc cctactactg
2881 tgacggcatt tccatccctc ccctgcccgg gaagggacct tgcagggacc tctccctcca
2941 aaaaaagaaa aaaagaaaaa gaaagaaaaa ataaatgagg aaacgtgttg cagcacaggc
3001 agttttcttc tccttctgct cccctgtttc tcataccccc aaactcagat gctggagctc
3061 aggcccgccg tgtgtgcacc caggcaggag cgggcgctgt ccaggctggg ccgccccctt
3121 ggctctccct cctgttccag gggagccata ggagggaaag caggtggccc gggggggata
3181 tgggggcccc agccctgtcc caaagctccc tgctcggctg cccctcgccc gcctttatat
3241 aaattctctg aatcaccttt gcatagaaaa taaaagtgtt tgctttgtaa gaaaa (SEQ ID NO: 7)

FIG. 8

MAAAAAAVGPGAGGAGSAVPGGAGPCATVSVFPGARLLTIGDANGEIQRHAEQQALRLEVRAGPDSAGIA
LYSHEDVCVFKCSVSRETECSRVGKQSFIITLGCNSVLIQFATPNDFCSFYNILKTCRGHTLERSVFSER
TEESSAVQYFQFYGYLSQQQNMMQDYVRTGTYQRAILQNHTDFKDKIVLDVGCGSGILSFFAAQAGARKI
YAVEASTMAQHAEVLVKSNNLTDRIVVIPGKVEEVSLPEQVDIIISEPMGYMLFNERMLESYLHAKKYLK
PSGNMFPTIGDVHLAPFTDEQLYMEQFTKANFWYQPSFHGVDLSALRGAAVDEYFRQPVVDTFDIRILMA
KSVKYTVNFLEAKEGDLHRIEIPFKFHMLHSGLVHGLAFWFDVAFIGSIMTVWLSTAPTEPLTHWYQVRC
LFQSPLFAKAGDTLSGTCLLIANKRQSYDISIVAQVDQTGSKSSNLLDLKNPFFRYTGTTPSPPPGSHYT
SPSENMWNTGSTYNLSSGMAVAGMPTAYDLSSVIASGSSVGHNNLIPLANTGIVNHTHSRMGSIMSTGIV
QGSSGAQGSGGGSTSAHYAVNSQFTMGGPAISMASPMSIPTNTMHYGS (SEQ ID NO: 8)

FIG. 9

1 acatttctgc agccgcgcgg cgagccattc gcggcggctg ctgcagctcc tactgcatct
61 tccttctctt cctttcctcg ggctccggtc tcggagtcgg agagcgcgcc tcgcttccag
121 agccccccgga cccggcgagt cagcgatcgc cgagccggcc accatgcccg gcagaccgcg
181 ccactaggcg ctcctcgcgg ctcccacccg gcggcggcgg cggcggcggc ggcgtccgcg
241 atggtttcag acgctgaagg attttgcatc tgatcgctcg gcgtttcaaa gaagcagcga
301 tcggag*atg*g atgtctctct ttgcccagcc aagtgtagtt tctggcggat tttcttgctg
361 ggaagcgtct ggctggacta tgtgggctcc gtgctggctt gccctgcaaa ttgtgtctgc
421 agcaagactg agatcaattg ccggcggccg gacgatggga acctcttccc cctcctggaa
481 gggcaggatt cagggaacag caatgggaac gccagtatca acatcacgga catctcaagg
541 aatatcactt ccatacacat agagaactgg cgcagtcttc acacgctcaa cgccgtggac
601 atggagctct acaccggact tcaaaagctg accatcaaga actcaggact tcggagcatt
661 cagcccagag cctttgccaa gaacccccat ttgcgttata taaacctgtc aagtaaccgg
721 ctcaccacac tctcgtggca gctcttccag acgctgagtc ttcgggaatt gcagttggag
781 cagaactttt tcaactgcag ctgtgacatc cgctggatgc agctctggca ggagcagggg
841 gaggccaagc tcaacagcca gaacctctac tgcatcaacg ctgatggctc ccagcttcct
901 ctcttccgca tgaacatcag tcagtgtgac cttcctgaga tcagcgtgag ccacgtcaac
961 ctgaccgtac gagagggtga caatgctgtt atcacttgca atggctctgg atcaccccctt
1021 cctgatgtgg actggatagt cactgggctg cagtccatca acactcacca gaccaatctg
1081 aactggacca atgttcatgc catcaacttg acgctggtga atgtgacgag tgaggacaat
1141 ggcttcaccc tgacgtgcat tgcagagaac gtggtgggca tgagcaatgc cagtgttgcc
1201 ctcactgtct actatccccc acgtgtggtg agcctggagg agcctgagct gcgcctggag
1261 cactgcatcg agtttgtggt gcgtggcaac ccccccaccaa cgctgcactg gctgcacaat
1321 gggcagcctc tgcgggagtc caagatcatc catgtggaat actaccaaga gggagagatt
1381 tccgagggct gcctgctctt caacaagccc acccactaca acaatggcaa ctataccctc
1441 attgccaaaa acccactggg cacagccaac cagaccatca atggccactt cctcaaggag
1501 ccctttccag agagcacgga taactttatc ttgtttgacg aagtgagtcc cacacctcct
1561 atcactgtga cccacaaacc agaagaagac acttttgggg tatccatagc agttggactt
1621 gctgcttttg cctgtgtcct gttggtggtt ctcttcgtca tgatcaacaa atatggtcga
1681 cggtccaaat ttggaatgaa gggtcccgtg gctgtcatca gtggtgagga ggactcagcc
1741 agcccactgc accacatcaa ccacggcatc accacgccct cgtcactgga tgccgggccc
1801 gacactgtgg tcattggcat gactcgcatc cctgtcattg agaaccccca gtacttccgt
1861 cagggacaca actgccacaa gccggacacg tatgtgcagc acattaagag gagagacatc
1921 gtgctgaagc gagaactggg tgagggagcc tttggaaagg tcttcctggc cgagtgctac
1981 aacctcagcc cgaccaagga caagatgctt gtggctgtga aggccctgaa ggatcccacc
2041 ctggctgccc ggaaggattt ccagagggag gccgagctgc tcaccaacct gcagcatgag
2101 cacattgtca agttctatgg agtgtgcggc gatggggacc ccctcatcat ggtctttgaa
2161 tacatgaagc atggagacct gaataagttc ctcagggccc atgggccaga tgcaatgatc
2221 cttgtggatg gacagccacg ccaggccaag ggtgagctgg ggctctccca aatgctccac
2281 attgccagtc agatcgcctc gggtatggtg tacctggcct cccagcactt tgtgcaccga
2341 gacctggcca ccaggaactg cctggttgga gcgaatctgc tagtgaagat tggggacttc
2401 ggcatgtcca gagatgtcta cagcacggat tattacaggg tgggaggaca caccatgctc
2461 cccattcgct ggatgcctcc tgaaagcatc atgtaccgga agttcactac agagagtgat
2521 gtatggagct tcggggtgat cctctgggag atcttcacct atggaaagca gccatggttc
2581 caactctcaa acacggaggt cattgagtgc attacccaag gtcgtgtttt ggagcggccc
2641 cgagtctgcc ccaaagaggt gtacgatgtc atgctggggt gctggcagag ggaaccacag
2701 cagcggttga acatcaagga gatctacaaa atcctccatg ctttggggaa ggccaccccca
2761 atctacctgg acattcttgg c*tag*tggtgg ctggtggtca tgaattcata ctctgttgcc
2821 tcctctctcc ctgcctcaca tctcccttcc acctcacaac tccttccatc cttgactgaa
2881 gcgaacatct tcatataaac tcaagtgcct gctacacata caacactgaa aaaaggaaaa
2941 aaaaagaaag aaaaaaaaac cc (SEQ ID NO: 9)

FIG. 10

MDVSLCPAKCSFWRIFLLGSVWLDYVGSVLACPANCVCSKTEINCRRPDDGNLFPLLEGQDSGNSNGNAS
INITDISRNITSIHIENWRSLHTLNAVDMELYTGLQKLTIKNSGLRSIQPRAFAKNPHLRYINLSSNRLT
TLSWQLFQTLSLRELQLEQNFFNCSCDIRWMQLWQEQGEAKLNSQNLYCINADGSQLPLFRMNISQCDLP
EISVSHVNLTVREGDNAVITCNGSGSPLPDVDWIVTGLQSINTHQTNLNWTNVHAINLTLVNVTSEDNGF
TLTCIAENVVGMSNASVALTVYYPPRVVSLEEPELRLEHCIEFVVRGNPPPTLHWLHNGQPLRESKIIHV
EYYQEGEISEGCLLFNKPTHYNNGNYTLIAKNPLGTANQTINGHFLKEPFPESTDNFILFDEVSPTPPIT
VTHKPEEDTFGVSIAVGLAAFACVLLVVLFVMINKYGRRSKFGMKGPVAVISGEEDSASPLHHINHGITT
PSSLDAGPDTVVIGMTRIPVIENPQYFRQGHNCHKPDTYVQHIKRRDIVLKRELGEGAFGKVFLAECYNL
SPTKDKMLVAVKALKDPTLAARKDFQREAELLTNLQHEHIVKFYGVCGDGDPLIMVFEYMKHGDLNKFLR
AHGPDAMILVDGQPRQAKGELGLSQMLHIASQIASGMVYLASQHFVHRDLATRNCLVGANLLVKIGDFGM
SRDVYSTDYYRVGGHTMLPIRWMPPESIMYRKFTTESDVWSFGVILWEIFTYGKQPWFQLSNTEVIECIT
QGRVLERPRVCPKEVYDVMLGCWQREPQQRLNIKEIYKILHALGKATPIYLDILG (SEQ ID NO: 10)

FIG. 11

*ATG*GCAGCGGCGGCGGCGGTGGGGCCGGGCGCGGGCGGCGCGGGGTCGGCGGTCCCGGGCGGCGCGGGG
CCCTGCGCTACCGTGTCGGTGTTCCCCGGCGCCCGCCTCCTCACCATCGGCGACGCGAACGGCGAGATCCAG
CGGCACGCGGAGCAGCAGGCGCTGCGCCTCGAGGTGCGCGCCGGCCCGGACTCGGCGGCATCGCCCTCTAC
AGCCATGAAGATGTGTGTGTCTTTAAGTGCTCAGTGTCCCGAGAGACAGAGTGCAGCCGTGTGGGCAAGCAG
TCCTTCATCATCACCCTGGGCTGCAACAGCGTCCTCATCCAGTTCGCCACACCCAACGATTTCTGTTCCTTC
TACAACATCCTGAAAACCTGCCGGGGCCACACCCTGGAGCGGTCTGTGTTCAGCGAGCGGACGGAGGAGTCT
TCTGCCGTGCAGTACTTCCAGAAGCAGCGATCGGAGATGGATGTCTCTCTTTGCCCAGCCAAGTGTAGTTTC
TGGCGGATTTTCTTGCTGGGAAGCGTCTGGCTGGACTATGTGGGCTCCGTGCTGGCTTGCCCTGCAAATTGT
GTCTGCAGCAAGACTGAGATCAATTGCCGGCGGCCGGACGATGGGAACCTCTTCCCCCTCCTGGAAGGGCAG
GATTCAGGGAACAGCAATGGGAACGCCAGTATCAACATCACGGACATCTCAAGGAATATCACTTCCATACAC
ATAGAGAACTGGCGCAGTCTTCACACGCTCAACGCCGTGGACATGGAGCTCTACACCGGACTTCAAAAGCTG
ACCATCAAGAACTCAGGACTTCGGAGCATTCAGCCCAGAGCCTTTGCCAAGAACCCCCATTTGCGTTATATA
AACCTGTCAAGTAACCGGCTCACCACACTCTCGTGGCAGCTCTTCCAGACGCTGAGTCTTCGGGAATTGCAG
TTGGAGCAGAACTTTTTCAACTGCAGCTGTGACATCCGCTGGATGCAGCTCTGGCAGGAGCAGGGGGAGGCC
AAGCTCAACAGCCAGAACCTCTACTGCATCAACGCTGATGGCTCCCAGCTTCCTCTCTTCCGCATGAACATC
AGTCAGTGTGACCTTCCTGAGATCAGCGTGAGCCACGTCAACCTGACCGTACGAGAGGGTGACAATGCTGTT
ATCACTTGCAATGGCTCTGGATCACCCCTTCCTGATGTGGACTGGATAGTCACTGGGCTGCAGTCCATCAAC
ACTCACCAGACCAATCTGAACTGGACCAATGTTCATGCCATCAACTTGACGCTGGTGAATGTGACGAGTGAG
GACAATGGCTTCACCCTGACGTGCATTGCAGAGAACGTGGTGGGCATGAGCAATGCCAGTGTTGCCCTCACT
GTCTACTATCCCCCACGTGTGGTGAGCCTGGAGGAGCCTGAGCTGCGCCTGGAGCACTGCATCGAGTTTGTG
GTGCGTGGCAACCCCCCACCAACGCTGCACTGGCTGCACAATGGGCAGCCTCTGCGGGAGTCCAAGATCATC
CATGTGGAATACTACCAAGAGGGAGAGATTTCCGAGGGCTGCCTGCTCTTCAACAAGCCCACCCACTACAAC
AATGGCAACTATACCCTCATTGCCAAAAACCCACTGGGCACAGCCAACCAGACCATCAATGGCCACTTCCTC
AAGGAGCCCTTTCCAGAGAGCACGGATAACTTTATCTTGTTTGACGAAGTGAGTCCCACACCTCCTATCACT
GTGACCCACAAACCAGAAGAAGACACTTTTGGGGTATCCATAGCAGTTGGACTTGCTGCTTTTGCCTGTGTC
CTGTTGGTGGTTCTCTTCGTCATGATCAACAAATATGGTCGACGGTCCAAATTTGGAATGAAGGGTCCCGTG
GCTGTCATCAGTGGTGAGGAGGACTCAGCCAGCCCACTGCACCACATCAACCACGGCATCACCACGCCCTCG
TCACTGGATGCCGGGCCCGACACTGTGGTCATTGGCATGACTCGCATCCCTGTCATTGAGAACCCCCAGTAC
TTCCGTCAGGGACACAACTGCCACAAGCCGGACACGTATGTGCAGCACATTAAGAGGAGAGACATCGTGCTG
AAGCGAGAACTGGGTGAGGGAGCCTTTGGAAAGGTCTTCCTGGCCGAGTGCTACAACCTCAGCCCGACCAAG
GACAAGATGCTTGTGGCTGTGAAGGCCCTGAAGGATCCCACCCTGGCTGCCCGGAAGGATTTCCAGAGGGAG
GCCGAGCTGCTCACCAACCTGCAGCATGAGCACATTGTCAAGTTCTATGGAGTGTGCGGCGATGGGGACCCC
CTCATCATGGTCTTTGAATACATGAAGCATGGAGACCTGAATAAGTTCCTCAGGGCCCATGGGCCAGATGCA
ATGATCCTTGTGGATGGACAGCCACGCCAGGCCAAGGGTGAGCTGGGGCTCTCCCAAATGCTCCACATTGCC
AGTCAGATCGCCTCGGGTATGGTGTACCTGGCCTCCCAGCACTTTGTGCACCGAGACCTGGCCACCAGGAAC
TGCCTGGTTGGAGCGAATCTGCTAGTGAAGATTGGGGACTTCGGCATGTCCAGAGATGTCTACAGCACGGAT
TATTACAGGGTGGGAGGACACACCATGCTCCCCATTCGCTGGATGCCTCCTGAAAGCATCATGTACCGGAAG
TTCACTACAGAGAGTGATGTATGGAGCTTCGGGGTGATCCTCTGGGAGATCTTCACCTATGGAAAGCAGCCA
TGGTTCCAACTCTCAAACACGGAGGTCATTGAGTGCATTACCCAAGGTCGTGTTTTGGAGCGGCCCCGAGTC
TGCCCCAAAGAGGTGTACGATGTCATGCTGGGGTGCTGGCAGAGGGAACCACAGCAGCGGTTGAACATCAAG
GAGATCTACAAAATCCTCCATGCTTTGGGGAAGGCCACCCCAATCTACCTGGACATTCTTGGCTAG (SEQ
ID NO: 11)

FIG. 12

MAAAAAAVGPGAGGAGSAVPGGAGPCATVSVFPGAR
LLTIGDANGEIQRHAEQQALRLEVRAGPDSAGIALYSHE
DVCVFKCSVSRETECSRVGKQSFIITLGCNSVLIQFATP
NDFCSFYNILKTCRGHTLERSVFSERTEESSAVQYFQ*K*
*QRSE*MDVSLCPAKCSFWRIFLLGSVWLDYVGSVLACP
ANCVCSKTEINCRRPDDGNLFPLLEGQDSGNSNGNASI
NITDISRNITSIHIENWRSLHTLNAVDMELYTGLQKLTIKN
SGLRSIQPRAFAKNPHLRYINLSSNRLTTLSWQLFQTLS
LRELQLEQNFFNCSCDIRWMQLWQEQGEAKLNSQNLY
CINADGSQLPLFRMNISQCDLPEISVSHVNLTVREGDNA
VITCNGSGSPLPDVDWIVTGLQSINTHQTNLNWTNVHAI
NLTLVNVTSEDNGFTLTCIAENVVGMSNASVALTVYYPP
RVVSLEEPELRLEHCIEFVVRGNPPPTLHWLHNGQPLR
ESKIIHVEYYQEGEISEGCLLFNKPTHYNNGNYTLIAKNP
LGTANQTINGHFLKEPFPESTDNFILFDEVSPTPPITVTH
KPEEDTFGVSIAVGLAAFACVLLVVLFVMINKYGRRSKF
GMKGPVAVISGEEDSASPLHHINHGITTPSSLDAGPDTV
VIGMTRIPVIENPQYFRQGHNCHKPDTYVQHIKRRDIVL
KRELGEGAFGKVFLAECYNLSPTKDKMLVAVKALKDPT
LAARKDFQREAELLTNLQHEHIVKFYGVCGDGDPLIMV
FEYMKHGDLNKFLRAHGPDAMILVDGQPRQAKGELGL
SQMLHIASQIASGMVYLASQHFVHRDLATRNCLVGANL
LVKIGDFGMSRDVYSTDYYRVGGHTMLPIRWMPPESIM
YRKFTTESDVWSFGVILWEIFTYGKQPWFQLSNTEVIE
CITQGRVLERPRVCPKEVYDVMLGCWQREPQQRLNIK
EIYKILHALGKATPIYLDILG (SEQ ID NO: 12)

FIG. 13

CCGGCAGCCAATGAGACCGTGCGGCACGGGTGTCT
GCGCCTCAACCAGCCCACCCACGTCAACAACGGCAA
CTACACGCTGCTGGCTGCCAACCCCTTCGGCCAGG
CCTCCGCCTCCATCATGGCTGCCTTCATGGACAACC
CTTTCGAGTTCAACCCCGAGGACCCCATCCCTGGTG
CGAGGGCCATCCTGAACCCTGCCCCCACTCCTGGG
CTCCTCCTGGGTTACAGCCAACTTCCTGCTATAGCC
CTGACCCCAGAAATTGGAGTGCCTGGTTCGGGACAG
AAAGGAGTCTGGAGTCCTGGTGTCCCGCTGTTCTGG
CCTCCTTACCCTCTCCCCAAGCCAGGACTCCTGAAC
TCCTGAGCTATTCCGTCCTTGTCGGCTGGCTGAGGA
GACAGCCATGCAGCAGGGCATCCTGGCCCAGCTGG
AAAAGGGTCACATGCATCTTCTTCCTTGAGGCCCAG
CAGCCCACCTCCATCCCCCCTCGTCCCATGAAGGAA
TGAGTCCCAGAGTA (SEQ ID NO: 13)

FIG. 14

ATACTCAGTCTGGCTTCGAGGGCCAGGTCTCCCCCA
AAGTCTGTAACTCCAGGCGGCTGGGGGCCCCAGGG
ATGCCCCCTCCCCAGCCTAGGAGCAGATACCAGAGT
ACAGGCTTCTGAGTAACTCTTTGCACATTCCGTCAGT
TTTTCTGGTTAGGAGTGGACACCCCCTCAGGACAGC
CTCCCTGGATTGGGAGACCGATCCCCTCCCCTTTCC
CTCTTCCAGTGCGAGGATATTTCTTTGTCTAAAGGCA
GAGTCCTGGGGGAGGAAGGATCTGGAGAACCGTCC
CGACTAGGGGTAACGGGGAACTTTGTGGCACTTTGA
AATCAGGGTAGGGGGCGGGTCCCCCTTTGTGGGGA
AGGGACAGAGCCGGAGGCGGGCAAGAAGGGAAGAA
ATGAACTTTCCGCGCTAGGGACGAGGGTGCCCCCAC
TACAGTCCCTCTCAGTGGTCCCGGCGCCCCGCTTAC
CTTGCCTGCCCACGATCTCGGCCACGTGCTCGGAG
GTGGGCACGGGAACACACTCCGTGGTGTTGCTGCT
GCCCTTCAGGCGCAGCTCGGCCTCTTTGTAGAGAGC
GCAGAGCTTGGCGTCGCTCGCCCCTTTGGGGGCGG
TGGGGGGCTGGGGCGTCTGCGCTGCGGGGGCCGC
CGTCGGGGC (SEQ ID NO: 14)

FIG. 15

TCGCGCCTCGCCAGGGCCGGAGTCACCTGGAATGC
GCAGCCGGAGAGCATCTCCCGAGCCAGAGCGAGCC
TGACGCGCGCCCAGCGGGCGGCGGGCAGCGGCGA
GCTGGGGCGGGCGGAGGGCCGGCTCCCGGCCGCG
GGTGGGCAGGAGGGAGACGCAGAGCGCGGGGGAG
GCAGGCTGGGGAGCGGCCGCCTGACTTACATGGAA
GTGATATTCCTTGAGATGTCCGTGATGTTGATACTGG
CGTTCCCATTGCTGTTCCCTGAATCCTGCCCTTCCAG
GAGGGGGAAGAGGTTCCCATCGTCCGGCCGCCGGC
AATTGATCTCAGTCTTGCTGCAGACACAATTTGCAGG
GCAAGCCAGCACGGAGCCCACATAGTCCAGCCAGA
CGCTTCCCAGCAAGAAAATCCGCCAGAAACTACACT
TGGCTGGGCAAAGAGAGACATCCATCTCCGATCGCT
GCTTCTAAAAAAGAGGAGGAGGAGAGGAGAGGGGG
GTGGGGTGGGGGGAGTGGGGAGAGCAGGGGGGGA
AGGAAACAAAGACGGCGAGGGAGGGGGGAAGGGG
GAGGGGGGGCCTCTGCCTTTGAAACGCCGAGCGAT
CAGATGCAAAATCCTTCAGCGTCTGAAACCATCGCG
GACGCCGCCGCCGCCGCCGCCGCCGCCGGGTGGG
AGCCGCGAGGAGCGCCTAGTGGCGCGGTCTG (SEQ
ID NO: 15)

FIG. 16

GGAAGCCAGGTCTGCCTGATGCCAAAGTCTGTGCCC
CTGCCCAGGTGCCACGCTGCCTCCCGATCGCCCGT
TGTCTTACAGAGAGACACCACACCTCACCTGCCTGG
CGCTCTGAGTTCTAGGGCTCTGTTCGATCTGCTTCTC
TTCTTCTTTGGGGCCCTCAAGATGAGGCAGGTGGCC
CCCGATGCCAGAACCCTGCCTGTGGCAAATCTTGAG
TTCTCCTGGGCGGCTTCCAGGTCCAGGCGGCATCAG
CTGTTGCCATCGGCTGCAGTGATAGTGGCGGTGTCC
TCCTGGGGGCTGCCCTCCGGCTTCCTGCTCCCTCTC
CTGGAGCTGCTAGTGGGGCCCAGGCAGAGGGTGCA
CGACCTCCCGAGGGAGGTTTGTGCCCTAGATGGCC
CCTTGCTCTATCACAGGGCTGGCCAGGGCCTTGGCT
GCCTCGTGCCACCATGTGCCCCGTGCCATCGGTATG
TCTCTGTTCCAGTTTTATGGCTACCTGTCCCAGCAGC
AGAACATGATGCAGGACTACGTGCGGACAGGCACCT
ACCAGCGCGCCATCCTGCAAAACCACACCGACTTCA
AGGACAAGGTGAGTGGCCCGCGCATGTGCCCACCT
CTCTGCTTCTGTCTCGGTTTTTTTTTTCTTTGCTCATT
GAT (SEQ ID NO: 16)

FIG. 17

| Fusion | Cancer type | Breakpoint 1 | Breakpoint 2 | Rearrangement |
|---|---|---|---|---|
| NTRK3-ADAMTSL3 | Soft tissue sarcoma (NOS) | 88576047-88576349 on chromosome 15 | 84564247-84564478 on chromosome 15 | Inversion |
| BLM-NTRK3 | Esophagus adenocarcinoma | 88576055-88576336 on chromosome 15 | 91294841-91295039 on chromosome 15 | Inversion |
| NTRK3-ACAN | Bladder adenocarcinoma | 88680708-88680926 on chromosome 15 | 89376765-89377051 on chromosome 15 | Inversion |
| MYO9A-NTRK3 | Breast carcinoma (NOS) | 88678239-88678576 on chromosome 15 | 72373590-72373836 on chromosome 15 | Duplication |
| NTRK2-PPP6R3 | Duodenum adenocarcinoma | 87285519-87285925 on chromosome 9 | 68341668-68342080 on chromosome 11 | Chr9:11 translocation |
| NTRK3-CDK12 | Breast carcinoma (NOS) | 88598683-88598950 on chromosome 15 | 37667762-37667934 on chromosome 17 | Chr15:17 translocation |
| FOXB2-NTRK2 | Breast carcinoma (NOS) | 87358998-87359350 on chromosome 9 | 79635277-79635505 on chromosome 9 | Deletion |
| NTRK3-EFTUD1 | Breast invasive ductal carcinoma (IDC) | 88671887-88672077 on chromosome 15 | 82450829-82450984 on chromosome 15 | Deletion |
| NOD1-NTRK2 | Bladder urothelial (transitional cell) carcinoma | 87322630-87323000 on chromosome 9 | 30485058-30485317 on chromosome 7 | Chr7:9 translocation |
| NTRK3-LRRK1 | Uterus adenosarcoma | 88726672-88726712 on chromosome 15 | 101586177-101586217 on chromosome 15 | Inversion |
| DENND1A-NTRK2 | Pancreas ductal adenocarcinoma | 87476021-87476185 on chromosome 9 | 126418577-126418820 on chromosome 9 | Inversion |

FIG. 18A

| Fusion | 5' Transcript ID | Last exon of 5' transcript | 3' Transcript ID | First exon of 3' transcript |
|---|---|---|---|---|
| NTRK3-ADAMTSL3 | NM_002530 | exon 14 | NM_207517 | exon 14 |
| BLM-NTRK3 | NM_000057 | exon 3 | NM_002530 | exon 14 |
| NTRK3-ACAN | NM_002530 | exon 7 | NM_001135 | exon 2 |
| MYO9A-NTRK3 | NM_006901 | exon 1 | NM_002530 | exon 10 |
| NTRK2-PPP6R3 | NM_006180 | exon 4 | NM_018312 | exon 14 |
| NTRK3-CDK12 | NM_002530 | exon 13 | NM_015083 | exon 8 |
| FOXB2-NTRK2 | NM_001013735 | exon 1 | NM_006180 | exon 13 |
| NTRK3-EFTUD1 | NM_002530 | exon 11 | NM_024580 | exon 17 |
| NOD1-NTRK2 | NM_006092 | exon 9 | NM_006180 | exon 8 |
| NTRK3-LRRK1 | NM_002530 | exon 5 | NM_024652 | exon 21 |
| DENND1A-NTRK2 | NM_020946 | exon 8 | NM_006180 | exon 16 |

FIG. 18B

1 gcggcgccgc gggctggagg ccggcgtcgg ggaaggtcct ggtgccggat tccgcacgag
61 gtgttgacgg gcggcttctg ccaacttctc cccagcgcgc gccgagcccg cgcggccccg
121 gggctgcacg tcccagatac ttctgcggcg caaggctaca actgagaccc ggaggagact
181 agacccc*atg* gcttcctgga cgagcccctg gtgggtgctg atagggatgg tcttcatgca
241 ctctcccctc ccgcagacca cagctgagaa atctcctgga gcctatttcc ttcccgagtt
301 tgcactttct cctcagggaa gttttctgga agacacaaca ggggagcagt tcctcactta
361 tcgctatgat gaccagacct caagaaacac tcgttcagat gaagacaaag atggcaactg
421 ggatgcttgg ggcgactgga gtgactgctc ccggacctgt gggggaggag catcatattc
481 tctgcggaga tgtttgactg gaaggaattg tgaagggcag aacattcggt acaagacatg
541 cagcaatcat gactgccctc cagatgcaga agatttcaga gcccagcagt gctcagccta
601 caatgatgtc cagtatcagg ggcattacta tgaatggctt ccacgatata atgatcctgc
661 tgccccgtgt gcactcaagt gtcatgcaca aggacaaaac ttggtggtgg agctggcacc
721 taaggtactg gatggaactc gttgcaacac ggactccttg gacatgtgta tcagtggcat
781 ctgtcaggca gtgggctgcg atcggcaact gggaagcaat gccaaggagg acaactgtgg
841 agtctgtgcc ggcgatggct ccacctgcag gcttgtacgg ggacaatcaa agtcacacgt
901 ttctcctgaa aaaagagaag aaaatgtaat tgctgttcct ttgggaagtc gaagtgtgag
961 aattacagtg aaaggacctg cccacctctt tattgaatca aaaacacttc aaggaagcaa
1021 aggagaacac agctttaaca gccccggcgt ctttctcgta gaaaacacaa cagtggaatt
1081 tcagaggggc tccgagaggc aaacttttaa gattccagga cctctgatgg ctgatttcat
1141 cttcaagacc aggtacactg cagccaaaga cagcgtggtt cagttcttct tttaccagcc
1201 catcagtcat cagtggagac aaactgactt ctttccctgc actgtgacgt gtggaggagg
1261 ttatcagctc aattctgctg aatgtgtgga tatccgcttg aagagggtag ttcctgacca
1321 ttattgtcac tactaccctg aaaatgtaaa accaaaacca aaactgaagg aatgcagcat
1381 ggatccctgc ccatcaagtg atggatttaa agagataatg ccctatgacc acttccaacc
1441 tcttcctcgc tgggaacata atccttggac tgcatgttcc gtgtcctgtg gaggagggat
1501 tcagagacgg agctttgtgt gtgtagagga atccatgcat ggagagatat tgcaggtgga
1561 agaatggaag tgcatgtacg cacccaaacc caaggttatg caaacttgta atctgtttga
1621 ttgccccaag tggattgcca tggagtggtc tcagtgcaca gtgacttgtg gccgagggtt
1681 acggtaccgg gttgttctgt gtattaacca ccgcggagag catgttgggg gctgcaatcc
1741 acaactgaag ttacacatca aagaagaatg tgtcattccc atcccgtgtt ataaaccaaa
1801 agaaaaaagt ccagtggaag caaaattgcc ttggctgaaa caagcacaag aactagaaga
1861 gaccagaata gcaacagaag aaccaacgtt cattccagaa ccctggtcag cctgcagtac
1921 cacgtgtggg ccgggtgtgc aggtccgtga ggtgaagtgc cgtgtgctcc tcacattcac
1981 gcagactgag actgagctgc ccgaggaaga gtgtgaaggc cccaagctgc ccaccgaacg
2041 gccctgcctc ctggaagcat gtgatgagag cccggcctcc cgagagctag acatccctct
2101 ccctgaggac agtgagacga cttacgactg ggagtacgct gggttcaccc cttgcacagc
2161 aacatgcgtg ggaggccatc aagaagccat agcagtgtgc ttacatatcc agacccagca
2221 gacagtcaat gacagcttgt gtgatatggt ccaccgtcct ccagccatga gccaggcctg
2281 taacacagag ccctgtcccc ccaggtggca tgtgggctct tgggggccct gctcagctac
2341 ctgtggagtt ggaattcaga cccgagatgt gtactgcctg cacccagggg agacccctgc
2401 ccctcctgag gagtgccgag atgaaaagcc ccatgcttta caagcatgca atcagtttga
2461 ctgccctcct ggctggcaca ttgaagaatg gcagcagtgt tccaggactt gtggcggggg

FIG. 19

2521 aactcagaac agaagagtca cctgtcggca gctgctaacg gatggcagct ttttgaatct
2581 ctcagatgaa ttgtgccaag gacccaaggc atcgtctcac aagtcctgtg ccaggacaga
2641 ctgtcctcca catttagctg tgggagactg gtcgaagtgt tctgtcagtt gtggtgttgg
2701 aatccagaga agaaagcagg tgtgtcaaag gctggcagcc aaaggtcggc gcatccccct
2761 cagtgagatg atgtgcaggg atctaccagg gctccctctt gtaagatctt gccagatgcc
2821 tgagtgcagt aaaatcaaat cagagatgaa gacaaaactt ggtgagcagg gtccgcagat
2881 cctcagtgtc cagagagtct acattcagac aagggaagag aagcgtatta acctgaccat
2941 tggtagcaga gcctatttgc tgcccaacac atccgtgatt attaagtgcc ccgtgcgacg
3001 attccagaaa tctctgatcc agtgggagaa ggatggccgt tgcctgcaga actccaaacg
3061 gcttggcatc accaagtcag gctcactaaa aatccatggt cttgctgccc ccgacatcgg
3121 cgtgtaccgg tgcattgcag gctctgcaca ggaaacagtt gtgctcaagc tcattggtac
3181 tgacaaccgg ctcatcgcac gcccagccct cagggagcct atgagggaat atcctgggat
3241 ggaccacagc gaagccaata gtttgggagt cacatggcac aaaatgaggc aaatgtggaa
3301 taacaaaaat gacctttatc tggatgatga ccacattagt aaccagcctt tcttgagagc
3361 tctgttaggc cactgcagca attctgcagg aagcaccaac tcctgggagt tgaagaataa
3421 gcagtttgaa gcagcagtta aacaaggagc atatagcatg gatacagccc agtttgatga
3481 gctgataaga aacatgagtc agctcatgga aaccggagag gtcagcgatg atcttgcgtc
3541 ccagctgata tatcagctgg tggccgaatt agccaaggca cagccaacac acatgcagtg
3601 gcggggcatc caggaagaga cacctcctgc tgctcagctc agaggggaaa cagggagtgt
3661 gtcccaaagc tcgcatgcaa aaaactcagg caagctgaca ttcaagccga aaggacctgt
3721 tctcatgagg caaagccaac ctccctcaat ttcatttaat aaaacaataa attccaggat
3781 tggaaataca gtatacatta caaaaaggac agaggtcatc aatatactgt gtgaccttat
3841 taccccccagt gaggccacat atacatggac caaggatgga accttgttac agccctcagt
3901 aaaaataatt ttggatggaa ctgggaagat acagatacag aatcctacaa ggaaagaaca
3961 aggcatatat gaatgttctg tagctaatca tcttggttca gatgtggaaa gttcttctgt
4021 gctgtatgca gaggcacctg tcatcttgtc tgttgaaaga aatatcacca aaccagagca
4081 caaccatctg tctgttgtgg ttggaggcat cgtggaggca gcccttggag caaacgtgac
4141 aatccgatgt cctgtaaaag gtgtccctca gcctaatata acttggttga agagaggagg
4201 atctctgagt ggcaatgttt ccttgctttt caatggatcc ctgttgttgc agaatgtttc
4261 ccttgaaaat gaaggaacct acgtctgcat agccaccaat gctcttggaa aggcagtggc
4321 aacatctgta ctccacttgc tggaacgaag atggccagag agtagaatcg tatttctgca
4381 aggacataaa aagtacattc tccaggcaac caacactaga accaacagca atgacccaac
4441 aggagaaccc ccgcctcaag agccttttg ggagcctggt aactggtcac attgttctgc
4501 cacctgtggt catttgggag cccgcattca gagaccccag tgtgtgatgg ccaatgggca
4561 ggaagtgagt gaggccctgt gtgatcacct ccagaagcca ctggctgggt ttgagccctg
4621 taacatccgg gactgcccag cgaggtggtt cacaagtgtg tggtcacagt gctctgtgtc
4681 ttgcggtgaa ggataccaca gtcggcaggt gacgtgcaag cggacaaaag ccaatggaac
4741 tgtgcaggtg gtgtctccaa gagcatgtgc ccctaaagac cggcctctgg gaagaaaacc
4801 atgttttggt catccatgtg ttcagtggga accagggaac cggtgtcctg gacgttgcat FIG. 19 (continued)

4861 gggccgtgct gtgaggatgc agcagcgtca cacagcttgt caacacaaca gctctgactc
4921 caactgtgat gacagaaaga <u>ga</u>cccacctt aagaaggaac tgcacatcag gggcctgtga
4981 tgtgtgttgg cacacaggcc cttggaagcc ctgtacagca gcctgtggca ggggtttcca
5041 gtctcggaaa gtcgactgta tccacacaag gagttgcaaa cctgtggcca agagacactg
5101 tgtacagaaa aagaaaccaa tttcctggcg gcactgtctt gggccctcct gtgat<u>ag</u>aga
5161 ctgcacagac acaactcact actgtatgtt tgtaaaacat cttaatttgt gttctctaga
5221 ccgctacaaa caaaggtgct gccagtcatg tcaagaggga *<u>taa</u>*acctttg gaggggtcat
5281 gatgctgctg tgaagataaa agtagaatat aaaagctctt ttccccatgt cgctgattca
5341 aaaacatgta tttcttaaaa gactagattc tatggatcaa acagaggttg atgcaaaaac
5401 accactgtta aggtgtaaag tgaaattttc caatggtagt tttatattcc aattttttaa
5461 aatgatgtat tcaaggatga acaaaatact atagcatgca tgccactgca cttgggacct
5521 catcatgtca gttgaatcga gaaatcacca agattatgag tgcatcctca cgtgctgcct
5581 ctttcctgtg atatgtagac tagcacagag tggtacatcc taaaaacttg ggaaacacag
5641 caacccatga cttcctcttc tctcaagttg caggttttca acagttttat aaggtatttg
5701 cattttagaa gctctggcca gtagttgtta agatgttggc attaatggca ttttcataga
5761 tccttggttt agtctgtgaa aaagaaacca tctctctgga taggctgtca cactgactga
5821 cctaagggtt catggaagca tggcatcttg tccttgcttt tagaacaccc atggaagaaa
5881 acacagagta gatattgctg tcatttatac aactacagaa atttatctat gacctaatga
5941 ggcatctcgg aagtcaaaga agagggaaag ttaacctttt ctactgattt cgtagtatat
6001 tcagagcttt cttttaagag ctgtgaatga aacttttttct aagcactatt ctattgcaca
6061 caaacagaaa accaaagcct tattagacct aatttatgca taaagtagta ttcctgagaa
6121 ctttattttg gaaaatttat aagaaagtaa tccaaataag aaacacgata gttgaaaata
6181 atttttatag taaataattg ttttgggctg atttttcagt aaatccaaag tgacttaggt
6241 tagaagttac actaaggacc aggggttgga atcagaattt agtttaagat ttgaggaaaa
6301 gggtaagggt tagtttcagt tttaggatta gagctagaat tgggttaggt gagaaagaaa
6361 gttaaggtta aggctagagt tgtctttaag ggttagggtt aggaccaggt taggtcaggg
6421 ttggattggg tttagattgg ggccagtgct ggtgttagtg atagtgtcag gatggaggtt
6481 aggtttggag taagcgttgt tgctgaagtg agttcaggct agcattaaat tgtaagttct
6541 gaagctgatt tggttatggg gtctttcccc tgtatactac cagttgtgtc tttagatggc
6601 acacaagtcc aaataagtgg tcatacttct ttattcaggg tctcagctgc ctgtacacct
6661 gctgcctaca tcttcttggc aacaaagtta cctgccacag gctctgctga gcctagttcc
6721 tggtcagtaa taactgaaca gtgcattttg gctttggatg tgtctgtgga caagcttgct
6781 gagtttctct accatattct gagcacacgg tctcttttgt tctaacttca gcttcactga
6841 cactgggttg agcactactg tatgtggagg gtttggtgat tgggaatgga tgggggacag
6901 tgaggaggac acaccagccc attagttgtt aatcatcaat cacatctgat tgttgaaggt
6961 tattaaatta aaagaaagat catttgtaac atactctttg tatatattta ttatatgaaa
7021 ggtgcaatat tttattttgt acagtatgta ataaagacat gggacatata tttttcttat
7081 taacaaaatt tcatattaaa ttgcttcact ttgtatttaa agttaaaagt tactattttt
7141 catttgctat tgtactttca ttgttgtcat tcaattgaca ttcctgtgta ctgtatttta
7201 ctactgtttt tataacatga gagttaatgt ttctgtttca tgatccttat gtaattcaga
7261 aataaattta ctttgattat tcagtggcat ccttataa<u>a</u>

FIG. 19 (continued)

atggatgtctctctttgcccagccaagtgtagtttctggcggattttcttgctgggaagcgtctggctggactatgtgg
gctccgtgctggcttgccctgcaaattgtgtctgcagcaagactgagatcaattgccggcggccggacgatggg
aacctcttccccctcctggaagggcaggattcagggaacagcaatgggaacgccagtatcaacatcacggac
atctcaaggaatatcacttccatacacatagagaactggcgcagtcttcacacgctcaacgccgtggacatgga
gctctacaccggacttcaaaagctgaccatcaagaactcaggacttcggagcattcagcccagagcctttgcc
aagaacccccatttgcgttatataaacctgtcaagtaaccggctcaccacactctcgtggcagctcttccagacg
ctgagtcttcgggaattgcagttggagcagaactttttcaactgcagctgtgacatccgctggatgcagctctggc
aggagcagggggaggccaagctcaacagccagaacctctactgcatcaacgctgatggctcccagcttcctc
tcttccgcatgaacatcagtcagtgtgaccttcctgagatcagcgtgagccacgtcaacctgaccgtacgagag
ggtgacaatgctgttatcacttgcaatggctctggatcaccccttcctgatgtggactggatagtcactgggctgca
gtccatcaacactcaccagaccaatctgaactggaccaatgttcatgccatcaacttgacgctggtgaatgtgac
gagtgaggacaatggcttcaccctgacgtgcattgcagagaacgtggtgggcatgagcaatgccagtgttgcc
ctcactgtctactatcccccacgtgtggtgagcctggaggagcctgagctgcgcctggagcactgcatcgagttt
gtggtgcgtggcaacccccccaccaacgctgcactggctgcacaatgggcagcctctgcgggagtccaagatc
atccatgtggaatactaccaagagggagagatttccgagggctgcctgctcttcaacaagcccacccactaca
acaatggcaactataccctcattgccaaaaacccactgggcacagccaaccagaccatcaatggccacttcct
caaggagccctttccagagagcacggataactttatcttgtttgacgaagtgagtcccacacctcctatcactgtg
acccacaaaccagaagaagacacttttggggtatccatagcagttggacttgctgcttttgcctgtgtcctgttggt
ggttctcttcgtcatgatcaacaaatatggtcgacggtccaaatttggaatgaagggtcccgtggctgtcatcagtg
gtgaggaggactcagccagcccactgcaccacatcaaccacggcatcaccacgccctcgtcactggatgcc
gggcccgacactgtggtcattggcatgactcgcatccctgtcattgagaacccccagtacttccgtcagggacac
aactgccacaagccggacacgttgcacagtgacttgtggccgagggttacggtaccgggttgttctgtgtattaa
ccaccgcggagagcatgttgggggctgcaatccacaactgaagttacacatcaaagaagaatgtgtcattccc
atcccgtgttataaaccaaaagaaaaaagtccagtggaagcaaaattgccttggctgaaacaagcacaagaa
ctagaagagaccagaatagcaacagaagaaccaacgttcattccagaaccctggtcagcctgcagtaccac
gtgtgggccgggtgtgcaggtccgtgaggtgaagtgccgtgtgctcctcacattcacgcagactgagactgagc
tgcccgaggaagagtgtgaaggccccaagctgcccaccgaacggccctgcctcctggaagcatgtgatgag
agcccggcctcccgagagctagacatccctctccctgaggacagtgagacgacttacgactgggagtacgct
gggttcaccccttgcacagcaacatgcgtgggaggccatcaagaagccatagcagtgtgcttacatatccaga
cccagcagacagtcaatgacagcttgtgtgatatggtccaccgtcctccagccatgagccaggcctgtaacac
agagccctgtcccccaggtggcatgtgggctcttgggggccctgctcagctacctgtggagttggaattcagac
ccgagatgtgtactgcctgcacccaggggagacccctgcccctcctgaggagtgccgagatgaaaagcccca
tgctttacaagcatgcaatcagtttgactgccctcctggctggcacattgaagaatggcagcagtgttccaggact
tgtggcgggggaactcagaacagaagagtcacctgtcggcagctgctaacggatggcagctttttgaatctctc
agatgaattgtgccaaggacccaaggcatcgtctcacaagtcctgtgccaggacagactgtcctcc

FIG. 20A acatttagctgtgggagactggtcgaagtgttctgtcagttgtggtgttggaatccagagaagaaagcaggtgtgtc
aaaggctggcagccaaaggtcggcgcatccccctcagtgagatgatgtgcagggatctaccagggctccctctt
gtaagatcttgccagatgcctgagtgcagtaaaatcaaatcagagatgaagacaaaacttggtgagcagggtcc
gcagatcctcagtgtccagagagtctacattcagacaagggaagagaagcgtattaacctgaccattggtagca
gagcctatttgctgcccaacacatccgtgattattaagtgccccgtgcgacgattccagaaatctctgatccagtgg
gagaaggatggccgttgcctgcagaactccaaacggcttggcatcaccaagtcaggctcactaaaaatccatgg
tcttgctgcccccgacatcggcgtgtaccggtgcattgcaggctctgcacaggaaacagttgtgctcaagctcattg
gtactgacaaccggctcatcgcacgcccagccctcagggagcctatgagggaatatcctgggatggaccacag
cgaagccaatagtttgggagtcacatggcacaaaatgaggcaaatgtggaataacaaaaatgacctttatctgg
atgatgaccacattagtaaccagcctttcttgagagctctgttaggccactgcagcaattctgcaggaagcaccaa
ctcctgggagttgaagaataagcagtttgaagcagcagttaaacaaggagcatatagcatggatacagcccagt
ttgatgagctgataagaaacatgagtcagctcatggaaaccggagaggtcagcgatgatcttgcgtcccagctga
tatatcagctggtggccgaattagccaaggcacagccaacacacatgcagtggcggggcatccaggaagaga
cacctcctgctgctcagctcagaggggaaacagggagtgtgtcccaaagctcgcatgcaaaaaactcaggcaa
gctgacattcaagccgaaaggacctgttctcatgaggcaaagccaacctccctcaatttcatttaataaaacaata
aattccaggattggaaatacagtatacattacaaaaaggacagaggtcatcaatatactgtgtgaccttattaccc
ccagtgaggccacatatacatggaccaaggatggaaccttgttacagccctcagtaaaaataattttggatggaa
ctgggaagatacagatacagaatcctacaaggaaagaacaaggcatatatgaatgttctgtagctaatcatcttg
gttcagatgtggaaagttcttctgtgctgtatgcagaggcacctgtcatcttgtctgttgaaagaaatatcaccaaacc
agagcacaaccatctgtctgttgtggttggaggcatcgtggaggcagcccttggagcaaacgtgacaatccgatg
tcctgtaaaaggtgtccctcagcctaatataacttggttgaagagaggaggatctctgagtggcaatgtttccttgctt
ttcaatggatccctgttgttgcagaatgtttcccttgaaaatgaaggaacctacgtctgcatagccaccaatgctcttg
gaaaggcagtggcaacatctgtactccacttgctggaacgaagatggccagagagtagaatcgtatttctgcaag
gacataaaaagtacattctccaggcaaccaacactagaaccaacagcaatgacccaacaggagaacccccg
cctcaagagcctttttgggagcctggtaactggtcacattgttctgccacctgtggtcatttgggagcccgcattcaga
gaccccagtgtgtgatggccaatgggcaggaagtgagtgaggccctgtgtgatcacctccagaagccactggct
gggtttgagccctgtaacatccgggactgcccagcgaggtggttcacaagtgtgtggtcacagtgctctgtgtcttg
cggtgaaggataccacagtcggcaggtgacgtgcaagcggacaaaagccaatggaactgtgcaggtggtgtct
ccaagagcatgtgcccctaaagaccggcctctgggaagaaaaccatgttttggtcatccatgtgttcagtgggaa
ccagggaaccggtgtcctggacgttgcatgggccgtgctgtgaggatgcagcagcgtcacacagcttgtcaaca
caacagctctgactccaactgtgatgacagaaagagacccaccttaagaaggaactgcacatcaggggcctgt
gatgtgtgttggcacacaggcccttggaagccctgtacagcagcctgtggcaggggtttccagtctcggaaagtc
gactgtatccacacaaggagttgcaaacctgtggccaagagacactgtgtacagaaaaagaaaccaatttcctg
gcggcactgtcttgggccctcctgtgatagagactgcacagacacaactcactactgtatgtttgtaaaacatctta
atttgtgttctctagaccgctacaaacaaaggtgctgccagtcatgtcaagagggataa FIG. 20A (continued)

MDVSLCPAKCSFWRIFLLGSVWLDYVGSVLACPANCVCSKTEINCRRPDDGNLFPL
LEGQDSGNSNGNASINITDISRNITSIHIENWRSLHTLNAVDMELYTGLQKLTIKNSGL
RSIQPRAFAKNPHLRYINLSSNRLTTLSWQLFQTLSLRELQLEQNFFNCSCDIRWMQ
LWQEQGEAKLNSQNLYCINADGSQLPLFRMNISQCDLPEISVSHVNLTVREGDNAVI
TCNGSGSPLPDVDWIVTGLQSINTHQTNLNWTNVHAINLTLVNVTSEDNGFTLTCIAE
NVVGMSNASVALTVYYPPRVVSLEEPELRLEHCIEFVVRGNPPPTLHWLHNGQPLR
ESKIIHVEYYQEGEISEGCLLFNKPTHYNNGNYTLIAKNPLGTANQTINGHFLKEPFPE
STDNFILFDEVSPTPPITVTHKPEEDTFGVSIAVGLAAFACVLLVVLFVMINKYGRRSK
FGMKGPVAVISGEEDSASPLHHINHGITTPSSLDAGPDTVVIGMTRIPVIENPQYFRQ
GHNCHKPDT[[first third of a Y]]CTVTCGRGLRYRVVLCINHRGEHVGGCNPQLKLHIKE
ECVIPIPCYKPKEKSPVEAKLPWLKQAQELEETRIATEEPTFIPEPWSACSTTCGPGV
QVREVKCRVLLTFTQTETELPEEECEGPKLPTERPCLLEACDESPASRELDIPLPED
SETTYDWEYAGFTPCTATCVGGHQEAIAVCLHIQTQQTVNDSLCDMVHRPPAMSQA
CNTEPCPPRWHVGSWGPCSATCGVGIQTRDVYCLHPGETPAPPEECRDEKPHAL
QACNQFDCPPGWHIEEWQQCSRTCGGGTQNRRVTCRQLLTDGSFLNLSDELCQG
PKASSHKSCARTDCPPHLAVGDWSKCSVSCGVGIQRRKQVCQRLAAKGRRIPLSE
MMCRDLPGLPLVRSCQMPECSKIKSEMKTKLGEQGPQILSVQRVYIQTREEKRINLT
IGSRAYLLPNTSVIIKCPVRRFQKSLIQWEKDGRCLQNSKRLGITKSGSLKIHGLAAP
DIGVYRCIAGSAQETVVLKLIGTDNRLIARPALREPMREYPGMDHSEANSLGVTWHK
MRQMWNNKNDLYLDDDHISNQPFLRALLGHCSNSAGSTNSWELKNKQFEAAVKQ
GAYSMDTAQFDELIRNMSQLMETGEVSDDLASQLIYQLVAELAKAQPTHMQWRGIQ
EETPPAAQLRGETGSVSQSSHAKNSGKLTFKPKGPVLMRQSQPPSISFNKTINSRIG
NTVYITKRTEVINILCDLITPSEATYTWTKDGTLLQPSVKIILDGTGKIQIQNPTRKEQGI
YECSVANHLGSDVESSSVLYAEAPVILSVERNITKPEHNHLSVVVGGIVEAALGANVT
IRCPVKGVPQPNITWLKRGGSLSGNVSLLFNGSLLLQNVSLENEGTYVCIATNALGK
AVATSVLHLLERRWPESRIVFLQGHKKYILQATNTRTNSNDPTGEPPPQEPFWEPGN
WSHCSATCGHLGARIQRPQCVMANGQEVSEALCDHLQKPLAGFEPCNIRDCPARW
FTSVWSQCSVSCGEGYHSRQVTCKRTKANGTVQVVSPRACAPKDRPLGRKPCFG
HPCVQWEPGNRCPGRCMGRAVRMQQRHTACQHNSSDSNCDDRKRPTLRRNCTS
GACDVCWHTGPWKPCTAACGRGFQSRKVDCIHTRSCKPVAKRHCVQKKKPISWR
HCLGPSCDRDCTDTTHYCMFVKHLNLCSLDRYKQRCCQSCQEG

FIG. 20B

ATGTTTTGGAAATTTGATCTTCACTCATCATCCCACATAGACACACTTCTAGAAAGA
GAAGATGTAACACTGAAGGAGTTAATGGATGAGGAAGATGTTTTACAGGAATGTAA
AGCTCAGAACCGCAAACTTATAGAGTTTCTGTTAAAAGCAGAATGTCTCGAAGATT
TAGTCTCATTCATTATAGAAGAACCACCTCAAGACATGGATGAAAAGATCAGATACA
AGTATCCAAATATATCTTGTGAGTTGCTCACTTCTGATGTCTCCCAGATGAATGATA
GACTGGGAGAAGATGAATCCTTGCTAATGAAATTATATAGCTTCCTCCTAAACGATT
CCCCTTTGAATCCACTACTTGCCAGTTTCTTCAGCAAGGTGCTAAGTATTCTTATCA
GCAGAAAACCAGAACAGATTGTGGATTTCTTAAAGAAGAAGCATGATTTTGTAGAC
CTTATTATAAAGCACATAGGAACTTCTGCTATCATGGATTTGTTGCTCAGGCTCCTG
ACGTGTATCGAACCTCCACAGCCCAGGCAAGATGTGCTGAATTGGTTAAATGAGG
AGAAAATTATCCAGAGGCTTGTGGAAATAGTTCATCCATCGCAAGAAGAAGATCGA
CATTCAAATGCATCACAATCACTTTGTGAAATTGTTCGCCTGAGCAGAGACCAGAT
GTTACAAATTCAGAACAGTACAGAGCCCGACCCCCTGCTTGCCACTCTAGAAAAG
CAAGAAATTATAGAGCAGCTTCTATCAAATATTTTCCACAAGGAGAAAAATGAGTCA
GCCATAGTCAGTGCAATCCAGATATTGCTGACTTTACTTGAGACACGACGACCAAC
ATTTGAAGGCCATATAGAGATCTGCCCACCAGGCATGAGCCATTCAGCTTGTTCAG
TAAACAAGAGTGTTCTAGAAGCCATCAGAGGAAGACTTGGATCTTTTCATGAACTC
CTGCTGGAGCCACCCAAGAACATGTTCTTCAAGTATACATGGAATAACTTTTTGCA
TACACAAGTGGAAATTTGTATTGCACTGATTCTTGCAAGTCCTTTTGAAAACACAG
AAAATGCCACAATTACCGATCAAGACTCCACTGGTGATAATTTGTTATTAAAACATC
TTTTCCAAAAATGTCAATTAATAGAACGAATACTTGAAGCCTGGGAAATGAATGAGA
AGAAACATTTCATCGCAAACCAGAAAAGGTTAGAAATCATCAACGAAGATGATGTT
GAAGCTTATGTGGGACTGAGAAATCTGACAATTGTGGATTCTGGATTAAAATTTGT
GGCTCATAAAGCATTTCTGAAAAACAGCAACCTGCAGCACATCAATTTTACCCGAA
ACAAACTGACGAGTTTGTCTAGGAAACATTTCCGTCACCTTGACTTGTCTGAACTG
ATCCTGGTGGGCAATCCATTTACATGCTCCTGTGACATTATGTGGATCAAGACTCT
CCAAGAGGCTAAATCCAGTCCAGACACTCAGGATTTGTACTGCCTGAATGAAAGC
AGCAAGAATATTCCCCTGGCAAACCTGCAGATACCCAATTGTGGTTTGCCATCTGC
AAATCTGGCCGCACCTAACCTCACTGTGGAGGAAGGAAAGTCTATCACATTATCCT
GTAGTGTGGCAGGTGATCCGGTTCCTAATATGTATTGGGATGTTGGTAACCTGGTT
TCCAAACATATGAATGAAACAAGCCACACACAGGGCTCCTTAAGGATAACTAACAT
TTCATCCGATGACAGTGGGAAGCAGATCTCTTGTGTGGCGGAAAATCTTGTAGGA
GAAGATCAAGATTCTGTCAACCTCACTGTGCATTTTGCACCAACTATCACATTTCTC
GAATCTCCAACCTCAGACCACCACTGGTGCATTCCATTCACTGTGAAAGGCAACC
CCAAACCAGCGCTTCAGTGGTTCTATAACGGGGCAATATTGAATGAGTCCAAATAC
ATCTGTACTAAAATACATGTTACCAATCACACGGAGTACCACGGCTGCCTCCAGCT
GGATAATCCCACTCACATGAACAATGGGGACTACACTCTAATAGCCAAGAATGAGT
ATGGGAAGGATGAGAAACAGATTTCTGCTCACTTCATGGGCTGGCCTGGAATTGA
CGATGGTGCAAACCCAAATTATCCTGATGTAATTTATGAAGATTATGGAACTGCAGC
GAATGACATCGGGGACACCACGAACAGAAGTAATGAAATCCCTTCCACAGACGTC

FIG. 21

ACTGATAAAACCGGTCGGGAACATCTCTCGGTCTATGCTGTGGTGGTGATTGCGT
CTGTGGTGGGATTTTGCCTTTTGGTAATGCTGTTTCTGCTTAAGTTGGCAAGACAC
TCCAAGTTTGGCATGAAAGATTTCTCATGGTTTGGATTTGGGAAAGTAAAATCAAG
ACAAGGTGTTGGCCCAGCCTCCGTTATCAGCAATGATGATGACTCTGCCAGCCCA
CTCCATCACATCTCCAATGGGAGTAACACTCCATCTTCTTCGGAAGGTGGCCCAG
ATGCTGTCATTATTGGAATGACCAAGATCCCTGTCATTGAAAATCCCCAGTACTTTG
GCATCACCAACAGTCAGCTCAAGCCAGACACATTTGTTCAGCACATCAAGCGACA
TAACATTGTTCTGAAAAGGGAGCTAGGCGAAGGAGCCTTTGGAAAAGTGTTCCTA
GCTGAATGCTATAACCTCTGTCCTGAGCAGGACAAGATCTTGGTGGCAGTGAAGA
CCCTGAAGGATGCCAGTGACAATGCACGCAAGGACTTCCACCGTGAGGCCGAGC
TCCTGACCAACCTCCAGCATGAGCACATCGTCAAGTTCTATGGCGTCTGCGTGGA
GGGCGACCCCCTCATCATGGTCTTTGAGTACATGAAGCATGGGGACCTCAACAAG
TTCCTCAGGGCACACGGCCCTGATGCCGTGCTGATGGCTGAGGGCAACCCGCC
CACGGAACTGACGCAGTCGCAGATGCTGCATATAGCCCAGCAGATCGCCGCGGG
CATGGTCTACCTGGCGTCCCAGCACTTCGTGCACCGCGATTTGGCCACCAGGAA
CTGCCTGGTCGGGGAGAACTTGCTGGTGAAAATCGGGGACTTTGGGATGTCCCG
GGACGTGTACAGCACTGACTACTACAGGGTCGGTGGCCACACAATGCTGCCCATT
CGCTGGATGCCTCCAGAGAGCATCATGTACAGGAAATTCACGACGGAAAGCGAC
GTCTGGAGCCTGGGGGTCGTGTTGTGGGAGATTTTCACCTATGGCAAACAGCCC
TGGTACCAGCTGTCAAACAATGAGGTGATAGAGTGTATCACTCAGGGCCGAGTCC
TGCAGCGACCCCGCACGTGCCCCCAGGAGGTGTATGAGCTGATGCTGGGGTGC
TGGCAGCGAGAGCCCCACATGAGGAAGAACATCAAGGGCATCCATACCCTCCTT
CAGAACTTGGCCAAGGCATCTCCGGTCTACCTGGACATTCTAGGCTAG

FIG. 21 (continued)

MFWKFDLHSSSHIDTLLEREDVTLKELMDEEDVLQECKAQNRKLI
EFLLKAECLEDLVSFIIEEPPQDMDEKIRYKYPNISCELLTSDVSQM
NDRLGEDESLLMKLYSFLLNDSPLNPLLASFFSKVLSILISRKPEQI
VDFLKKKHDFVDLIIKHIGTSAIMDLLLRLLTCIEPPQPRQDVLNWL
NEEKIIQRLVEIVHPSQEEDRHSNASQSLCEIVRLSRDQMLQIQNS
TEPDPLLATLEKQEIIEQLLSNIFHKEKNESAIVSAIQILLTLLETRRP
TFEGHIEICPPGMSHSACSVNKSVLEAIRGRLGSFHELLLEPPKNM
FFKYTWNNFLHTQVEICIALILASPFENTENATITDQDSTGDNLLLK
HLFQKCQLIERILEAWEMNEKKHFIANQKRLEIINEDDVEAYVGLR
NLTIVDSGLKFVAHKAFLKNSNLQHINFTRNKLTSLSRKHFRHLDLS
ELILVGNPFTCSCDIMWIKTLQEAKSSPDTQDLYCLNESSKNIPLA
NLQIPNCGLPSANLAAPNLTVEEGKSITLSCSVAGDPVPNMYWDV
GNLVSKHMNETSHTQGSLRITNISSDDSGKQISCVAENLVGEDQD
SVNLTVHFAPTITFLESPTSDHHWCIPFTVKGNPKPALQWFYNGAI
LNESKYICTKIHVTNHTEYHGCLQLDNPTHMNNGDYTLIAKNEYG
KDEKQISAHFMGWPGIDDGANPNYPDVIYEDYGTAANDIGDTTNR
SNEIPSTDVTDKTGREHLSVYAVVVIASVVGFCLLVMLFLLKLARH
SKFGMKDFSWFGFGKVKSRQGVGPASVISNDDDSASPLHHISNG
SNTPSSSEGGPDAVIIGMTKIPVIENPQYFGITNSQLKPDTFVQHIK
RHNIVLKRELGEGAFGKVFLAECYNLCPEQDKILVAVKTLKDASDN
ARKDFHREAELLTNLQHEHIVKFYGVCVEGDPLIMVFEYMKHGDL
NKFLRAHGPDAVLMAEGNPPTELTQSQMLHIAQQIAAGMVYLAS
QHFVHRDLATRNCLVGENLLVKIGDFGMSRDVYSTDYYRVGGHT
MLPIRWMPPESIMYRKFTTESDVWSLGVVLWEIFTYGKQPWYQL
SNNEVIECITQGRVLQRPRTCPQEVYELMLGCWQREPHMRKNIK
GIHTLLQNLAKASPVYLDILG

FIG. 22

1 cacctacctc cccgccgctc cagagggggc tcgcagagct gaggacgcgc gcagcgctgc
61 tcaaggtctc tctctctcag caccctcgcc ggccggcgtc tgacgcgggt gccagggtct
121 ccgggcacct ttcagtgtcc attccctcag ccagccagga ctccgcaacc cagcagttgc
181 cgctgcggcc acagcccgag gggacctgcg gacaggacgc cggcaggagg aggggtgcgc
241 agcgcccgcg cagagcgtct ccctcgctac gcagcgagac ccgggcctcc cggccccagg
301 agcccccagc tgcctcgcca ggtgtgtggg actgaagttc ttggagaagg gagtccaact
361 cttcaaggtg aact*atg*acc actttactct gggttttcgt gactctgagg gtcatcactg
421 cagctgtcac tgtagaaact tcagaccatg acaactcgct gagtgtcagc atcccccaac
481 cgtccccgct gagggtcctc ctggggacct ccctcaccat cccctgctat ttcatcgacc
541 ccatgcaccc tgtgaccacc gccccttcta ccgcccccact ggccccaaga atcaagtgga
601 gccgtgtgtc caaggagaag gaggtagtgc tgctggtggc cactgaaggg cgcgtgcggg
661 tcaacagtgc ctatcaggac aaggtctcac tgcccaacta cccggccatc cccagtgacg
721 ccaccttgga agtccagagc ctgcgctcca atgactctgg ggtctaccgc tgcgaggtga
781 tgcatggcat cgaggacagc gaggccaccc tggaagtcgt ggtgaaaggc atcgtgttcc
841 attacagagc catctctaca cgctacaccc tcgactttga cagggcgcag cgggcctgcc
901 tgcagaacag tgccatcatt gccacgcctg agcagctgca ggccgcctac gaagacggct
961 tccaccagtg tgacgccggc tggctggctg accagactgt cagatacccc atccacactc
1021 cccgggaagg ctgctatgga gacaaggatg agtttcctgg tgtgaggacg tatggcatcc
1081 gagacaccaa cgagacctat gatgtgtact gcttcgccga ggagatggag ggtgaggtct
1141 tttatgcaac atctccagag aagttcacct tccaggaagc agccaatgag tgccggcggc
1201 tgggtgcccg gctggccacc acgggccagc tctacctggc ctggcaggct ggcatggaca
1261 tgtgcagcgc cggctggctg gccgaccgca gcgtgcgcta ccccatctcc aaggcccggc
1321 ccaactgcgg tggcaacctc ctgggcgtga ggaccgtcta cgtgcatgcc aaccagacgg
1381 gctaccccga cccctcatcc cgctacgacg ccatctgcta cacaggtgaa gactttgtgg
1441 acatcccaga aaacttcttt ggagtggggg gtgaggagga catcaccgtc cagacagtga
1501 cctggcctga catggagctg ccactgcctc gaaacatcac tgagggtgaa gcccgaggca
1561 gcgtgatcct taccgtaaag cccatcttcg aggtctcccc cagtcccctg gaacccgagg
1621 agcccttcac gtttgcccct gaaatagggg ccactgcctt cgctgaggtt gagaatgaga
1681 ctggagaggc caccaggccc tggggctttc ccacacctgg cctgggccct gccacggcat
1741 tcaccagtga ggacctcgtc gtgcaggtga ccgctgtccc tgggcagccg catttgccag
1801 ggggggtcgt cttccactac cgcccgggac ccacccgcta ctcgctgacc tttgaggagg
1861 cacagcaggc ctgcctgcgc acgggggcgg tcattgcctc gccggagcag ctccaggccg
1921 cctacgaagc aggctatgag cagtgtgacg ccggctggct gcgggaccag accgtcagat
1981 accccattgt gagcccccgg accccatgcg tgggtgacaa ggacagcagc ccaggggtca
2041 ggacctatgg cgtgcgccca tcaacagaga cctacgatgt ctactgcttt gtagacagac
2101 ttgaggggga ggtgttcttc gccacacgcc ttgagcagtt caccttccag gaagcactgg
2161 agttctgtga atctcacaat gctacgctgg ccaccacggg ccagctctac gccgcctgga
2221 gccgcggcct ggacaagtgc tatgccggct ggctggccga cggcagcctc cgctacccca
2281 tcgtcacccc aaggcctgcc tgcggtgggg acaagccagg cgtgagaacg gtctacctct
2341 accctaacca gacgggcctc ccagacccac tgtcccggca ccatgccttc tgcttccgag
2401 gcatttcagc ggttccttct ccaggagaag aagagggtgg cacacccaca tcaccctctg
2461 gtgtggagga gtggatcgtg acccaagtgg ttcctggtgt ggctgctgtc cccgtagaag

FIG. 23

2521 aggagacaac tgctgtaccc tcaggggaga ctactgccat cctagagttc accaccgagc
2581 cagaaaacca gacagaatgg gaaccagcct ataccccagt gggcacatcc ccgctgccag
2641 ggatccttcc tacttggcct cccactggcg cagcaacaga ggaaagtaca gaaggccctt
2701 ctgcaactga agtgccctct gcctcagagg aaccatcccc ctcagaggtg ccattcccct
2761 cagaggagcc atccccctca gaggaaccat tcccctcagt gaggccattc ccctcagtgg
2821 agctgttccc ctcagaggag ccattcccct ccaaggagcc atccccctca gaggaaccat
2881 cagcctcgga agagccgtat acaccttcac cccccgtgcc cagctggact gagctgccca
2941 gctctgggga ggaatctggg gcccctgatg tcagtggtga cttcacaggc agtggagatg
3001 tttcaggaca ccttgacttc agtgggcagc tgtcagggga cagggcaagt ggactgccct
3061 ctggagacct ggactccagt ggtcttactt ccacagtggg ctcaggcctg cctgtggaaa
3121 gtggactacc ctcaggggat gaagagagaa ttgagtggcc cagcactcct acggttggtg
3181 aactgccctc tggagctgag atcctagagg gctctgcctc tggagttggg gatctcagtg
3241 gacttccttc tggagaagtt ctagagacct ctgcctctgg agtaggagac ctcagtgggc
3301 ttccttctgg agaagttcta gagaccactg cccctggagt agaggacatc agcgggcttc
3361 cttctggaga agttctagag accactgccc ctggagtaga ggacatcagc gggcttcctt
3421 ctggagaagt tctagagacc actgcccctg gagtagagga catcagcggg cttccttctg
3481 gagaagttct agagaccact gcccctggag tagaggacat cagcgggctt ccttctggag
3541 aagttctaga gaccactgcc cctggagtag aggacatcag cgggcttcct tctggagaag
3601 ttctagagac cactgcccct ggagtagagg acatcagcgg gcttccttct ggagaagttc
3661 tagagaccgc tgcccctgga gtagaggaca tcagcgggct tccttctgga gaagttctag
3721 agaccgctgc ccctggagta gaggacatca gcgggcttcc ttctggagaa gttctagaga
3781 ccgctgcccc tggagtagag gacatcagcg ggcttccttc tggagaagtt ctagagaccg
3841 ctgcccctgg agtagaggac atcagcgggc ttccttctgg agaagttcta gagaccgctg
3901 cccctggagt agaggacatc agcgggcttc cttctggaga agttctagag accgctgccc
3961 ctggagtaga ggacatcagc gggcttcctt ctggagaagt tctagagacc gctgcccctg
4021 gagtagagga catcagcggg cttccttctg gagaagttct agagactgct gcccctggag
4081 tagaggacat cagcgggctt ccttctggag aagttctaga gactgctgcc cctggagtag
4141 aggacatcag cgggcttcct tctggagaag ttctagagac tgctgcccct ggagtagagg
4201 acatcagcgg gcttccttct ggagaagttc tagagactgc tgcccctgga gtagaggaca
4261 tcagcgggct tccttctgga gaagttctag agactgctgc ccctggagta gaggacatca
4321 gcgggcttcc ttctggagaa gttctagaga ctgctgcccc tggagtagag gacatcagcg
4381 ggcttccttc tggagaagtt ctagagactg ctgcccctgg agtagaggac atcagcgggc
4441 ttccttctgg agaagttcta gagactgctg cccctggagt agaggacatc agcgggcttc
4501 cttctggaga agttctagag actgctgccc ctggagtaga ggacatcagc gggcttcctt
4561 ctggagaagt tctagagact actgcccctg gagtagagga gatcagcggg cttccttctg
4621 gagaagttct agagactact gcccctggag tagatgagat cagtgggctt ccttctggag
4681 aagttctaga gactactgcc cctggagtag aggagatcag cgggcttcct tctggagaag
4741 ttctagagac ttctacctct gcggtagggg acctcagtgg acttccttct ggaggagaag
4801 ttctagagat ttctgtctct ggagtagagg acatcagtgg gcttccttct ggagaggttg
4861 tagagacttc tgcctctgga atagaggatg tcagtgaact tccttcagga gaaggtctag
4921 agacctctgc ttctggagta gaggacctca gcaggctccc ttctggagaa gaagttctag
4981 agatttctgc ctctggattt ggggacctca gtggacttcc ttctggagga gaaggtctag
5041 agacctctgc ttctgaagta gggactgacc tcagtgggct tccttctgga agggagggtc FIG. 23 (continued)

5101 tagagacttc agcttctgga gctgaggacc tcagtgggtt gccttctgga aaagaagact
5161 tggtggggtc agcttctgga gacttggact tgggcaaact gccttctgga actctaggaa
5221 gtgggcaagc tccagaaaca agtggtcttc cctctggatt tagtggtgag tattctgggg
5281 tggaccttgg aagtggccca ccctctggcc tgcctgactt tagtggactt ccatctggat
5341 tcccaactgt ttccctagtg gattctacat tggtggaagt ggtcacagcc tccactgcaa
5401 gtgaactgga agggagggga accattggca tcagtggtgc aggagaaata tctggactgc
5461 cctccagtga gctggacatt agtgggagag ctagtggact cccttcagga actgaactca
5521 gtggccaagc atctgggtct cctgatgtca gtggggaaat acctggactc tttggtgtca
5581 gtggacagcc atcagggttt cctgacacta gtggggaaac atctggagtg actgagctta
5641 gcgggctgtc ctctggacaa ccaggtatta gtggagaagc atctggagtt ctttatggca
5701 ctagtcaacc ctttggcata actgatctga gtggagaaac atctggggtc cctgatctca
5761 gtgggcagcc ttcagggtta ccagggttca gtggggcaac atcaggagtc cctgacctgg
5821 tttctggtac cacgagtggc agcggtgaat cttctgggat tacatttgtg gacaccagtt
5881 tggttgaagt ggcccctact acatttaaag aagaagaagg cttagggtct gtggaactca
5941 gtggcctccc ttccggagag gcagatctgt caggcaaatc tgggatggtg gatgtcagtg
6001 gacagttttc tggaacagtc gattccagtg ggtttacatc ccagactccg gaattcagtg
6061 gcctaccaag tggcatagct gaggtcagtg gagaatcctc cagagctgag attgggagca
6121 gcctgccctc gggagcatat tatggcagtg gaactccatc tagtttcccc actgtctctc
6181 ttgtagacag aactttggtg gaatctgtaa cccaggctcc aacagcccaa gaggcaggag
6241 aagggccttc tggcatttta gaactcagtg gtgctcattc tggagcacca gacatgtctg
6301 gggagcattc tggatttctg gacctaagtg ggctgcagtc cgggctgata gagcccagcg
6361 gagagccacc aggtactcca tattttagtg gggattttgc cagcaccacc aatgtaagtg
6421 gagaatcctc tgtagccatg ggcaccagtg gagaggcctc aggacttcca gaagttactt
6481 taatcacttc tgagttcgtg gagggtgtta ctgaaccaac tatttctcag gaactaggcc
6541 aaaggccccc tgtgacacac acaccccagc tttttgagtc cagtggaaaa gtctccacag
6601 ctggggacat tagtggagct accccagtgc tccctgggtc tggagtagaa gtatcatcag
6661 tcccagaatc tagcagtgag acgtccgcct atcctgaagc tgggttcggg gcatctgccg
6721 cccctgaggc cagcagagaa gattctgggt cccctgatct gagtgaaacc acctctgcat
6781 tccacgaagc taaccttgag agatcctctg gcctaggagt gagcggcagc actttgacat
6841 ttcaagaagg cgaggcgtcc gctgccccag aagtgagtgg agaatccacc accaccagtg
6901 atgtggggac agaggcacca ggcttgcctt cagccactcc cacggcttct ggagacagga
6961 ctgaaatcag cggagacctg tctggtcaca cctcgcagct gggcgttgtc atcagcacca
7021 gcatcccaga gtctgagtgg acccagcaga cccagcgccc tgcagagacg catctagaaa
7081 ttgagtcctc aagcctcctg tactcaggag aagagactca cacagtcgaa acagccacct
7141 ccccaacaga tgcttccatc ccagcttctc cggaatggaa acgtgaatca gaatcaactg
7201 ctgca<u>ga</u>cca ggaggtatgt gaggagggct ggaacaagta ccagggccac tgttaccgcc
7261 acttcccgga ccgcgagacc tgggtggatg ctgagcgccg gtgtcgggag cagcagtcac
7321 acctgagcag catcgtcacc cccgaggagc aggagtttgt caac<u>aa</u>caat gcccaagact
7381 accagtggat cggcctgaac gacaggacca tcgaagggga cttccgctgg tcagatggac
7441 accccat<u>gc</u>a atttgagaac tggcgcccca accagcctga caactttttt gccgctggag
7501 aggactgtgt ggtgatgatc tggcacgaga agggcgagtg gaatgatgtt ccctgcaatt
7561 accacctccc cttcacgtgt aaaaagggca ca<u>gc</u>caccac ctacaaacgc agactacaga FIG. 23 (continued)

7621 agcggagctc acggcaccct cggaggagcc gccccagcac agcccac*<u>tga</u>* gaagagcttc
7681 caggacgcac ccaggacgct gagcccagga gcctgccagg ctgacgtgca tcccacccag
7741 acggtgtcct cttcttgtcg ctttttgtca tataaggaat cccattaaag aaggaaaaaa
7801 ataaatccca catttgtgta tgcacccact cacccctcca aatcagcaaa accgcatcta
7861 atttgtccgc cgaatgccaa agcaaagcaa acttattata acccttggac tgagtttaga
7921 gacatttctt caatttccca tcgtgccttt ccagggacca gtgcagggac agggggagaa
7981 ggggaggggt taagttaaat aaagaagatt atttttgttt cctgacttta tccaagagca
8041 gtgcaatcgt tggttatttc acctccaggg agagctaggg aggagggagg agggctccaa
8101 aggagctgga aggagcagag gcctgagagc aggaagaact cggaaccgca gctgaatgta
8161 ttggatgaga aggagccagg agggctacac catctgtatg agggaaaagc cttgggggag
8221 aggggtgggt tcctgcctcc tgccgagggt aagccggcag gagagagcca tcagagggac
8281 ctccgctgcc tgggagttgg gttccctcca agggtccctc tttcagtgtc ctctctctca
8341 cctgggtctg ccaccctaac aggtggcaac tcggcagggc tgctgggggc acttcctgcc
8401 cagtgggggg tgccgcccaa ccttctcccc tccccacccc cgcccccggg accgtgcagg
8461 caccagggtt ccgtgcacct atttatattt ttgaaaactg aagattataa tattataata
8521 ataataaaga cattggaaga ga<u>t</u>

FIG. 23 (continued)

1 ccggcgggaa gtgagccagg gcttggcgcg gcggccgtgg ttgcggcgcg ggaagtttgg
61 atcctggttc cgtccgctag gagtctgcgt gcgaggatt*a tg*gctgctgt tcctcaaaat
121 aatctacagg agcaactaga acgtcactca gccagaacac ttaataataa attaagtctt
181 tcaaaaccaa aattttcagg tttcactttt aaaaagaaaa catcttcaga taacaatgta
241 tctgtaacta atgtgtcagt agcaaaaaca cctgtattaa gaaataaaga tgttaatgtt
301 accgaagact tttccttcag tgaacctcta cccaacacca caaatcagca aagggtcaag
361 gacttcttta aaaatgctcc agcaggacag gaaacacaga gaggtggatc aaaatcatta
421 ttgccagatt tcttgcagac tccgaaggaa gttgtatgca ctacccaaaa cacaccaact
481 gtaaagaaat cccgggatac tgctctcaag aaattagaat ttagttcttc accagattct
541 ttaagtacca tcaatgattg ggatgatatg gatgactttg atacttctga gacttcaaaa
601 tcatttgtta caccacccca aagtcacttt gtaagagtaa gcactgctca gaaatcaaaa
661 aagggtaaga gaaacttttt taaagcacag ctttatacaa caaacacagt aaagactgat
721 ttgcctccac cctcctctga aagcgagcaa atagatttga ctgaggaaca gaaggatgac
781 tcagaatggt taagcagcga tgtgatttgc atcgatgatg gccccattgc tgaagtgcat
841 ataaatgaag atgctcagga aagtgactct ctgaaaactc atttggaaga tgaaagagat
901 aatagcgaaa agaagaagaa tttggaagaa gctgaattac attcaactga gaaagttcca
961 tgtattgaat ttgatgatga tgattatgat acggattttg ttccaccttc tccagaagaa
1021 attatttctg cttcttcttc ctcttcaaaa tgccttagta cgttaaagga ccttgacacc
1081 tctgacagaa aagaggatgt tcttagcaca tcaaaagatc ttttgtcaaa acctgagaaa
1141 atgagtatgc aggagctgaa tccagaaacc agcacagact gtgacgctag acagataagt
1201 ttacagcagc agcttattca tgtgatggag cacatctgta aattaattga tactattcct
1261 gatgataaac tgaaactttt ggattgtggg aacgaactgc ttcagcagcg gaacataaga
1321 aggaaacttc taacggaagt agattttaat aaaagtgatg ccagtcttct tggctcattg
1381 tggagataca ggcctgattc acttgatggc cctatggagg gtgattcctg ccctacaggg
1441 aattctatga aggagttaaa tttttcacac cttccctcaa attctgtttc tcctggggac
1501 tgtttactga ctaccaccct aggaaagaca ggattctctg ccaccaggaa gaatcttttt
1561 gaaaggcctt tattcaatac ccatttacag aagtcctttg taagtagcaa ctgggctgaa
1621 acaccaagac taggaaaaaa aaatgaaagc tcttatttcc caggaaatgt tctcacaagc
1681 actgctgtga aagatcagaa taaacatact gcttcaataa atgacttaga aagagaaacc
1741 caaccttcct atgatattga taattttgac atagatgact ttgatgatga tgatgactgg
1801 gaagacataa tgcataattt agcagccagc aaatcttcca cagctgccta tcaacccatc
1861 aaggaaggtc ggccaattaa atcagtatca gaaagacttt cctcagccaa gacagactgt
1921 cttccagtgt catctactgc tcaaaatata aacttctcag agtcaattca gaattatact
1981 gacaagtcag cacaaaattt agcatccaga aatctgaaac atgagcgttt ccaaagtctt
2041 agttttcctc atacaaagga aatgatgaag atttttcata aaaaatttgg cctgcataat
2101 tttagaacta atcagctaga ggcgatcaat gctgcactgc ttggtgaaga ctgttttatc
2161 ctgatgccga ctggaggtgg taagagtttg tgttaccagc tccctgcctg tgtttctcct
2221 ggggtcactg ttgtcatttc tcccttgaga tcacttatcg tagatcaagt ccaaaagctg
2281 acttccttgg atattccagc tacatatctg acaggtgata agactgactc agaagctaca
2341 aatatttacc tccagttatc aaaaaaagac ccaatcataa aacttctata tgtcactcca
2401 gaaaagatct gtgcaagtaa cagactcatt tctactctgg agaatctcta tgagaggaag

FIG. 24A 2461 ctcttggcac gttttgttat tgatgaagca cattgtgtca gtcagtgggg acatgatttt
2521 cgtcaagatt acaaaagaat gaatatgctt cgccagaagt ttccttctgt tccggtgatg
2581 gctcttacgg ccacagctaa tcccagggta cagaaggaca tcctgactca gctgaagatt
2641 ctcagacctc aggtgtttag catgagcttt aacagacata atctgaaata ctatgtatta
2701 ccgaaaaagc ctaaaaaggt ggcatttgat tgcctagaat ggatcagaaa gcaccaccca
2761 tatgattcag ggataattta ctgcctctcc aggcgagaat gtgacaccat ggctgacacg
2821 ttacagagag atgggctcgc tgctcttgct taccatgctg gcctcagtga ttctgccaga
2881 gatgaagtgc agcagaagtg gattaatcag gatggctgtc aggttatctg tgctacaatt
2941 gcatttggaa tggggattga caaaccggac gtgcgatttg tgattcatgc atctctccct
3001 aaatctgtgg agggttacta ccaagaatct ggcagagctg gaagagatgg ggaaatatct
3061 cactgcctgc ttttctatac ctatcatgat gtgaccagac tgaaaagact tataatgatg
3121 gaaaaagatg gaaaccatca tacaagagaa actcacttca ataatttgta tagcatggta
3181 cattactgtg aaaatataac ggaatgcagg agaatacagc ttttggccta ctttggtgaa
3241 aatggattta atcctgattt ttgtaagaaa cacccagatg tttcttgtga taattgctgt
3301 aaaacaaagg attataaaac aagagatgtg actgacgatg tgaaaagtat tgtaagattt
3361 gttcaagaac atagttcatc acaaggaatg agaaatataa aacatgtagg tccttctgga
3421 agatttacta tgaatatgct ggtcgacatt ttcttgggga gtaagagtgc aaaaatccag
3481 tcaggtatat ttggaaaagg atctgcttat tcacgacaca atgccgaaag actttttaaa
3541 aagctgatac ttgacaagat tttggatgaa gacttatata tcaatgccaa tgaccaggcg
3601 atcgcttatg tgatgctcgg aaataaagcc caaactgtac taaatggcaa tttaaaggta
3661 gactttatgg aaacagaaaa ttccagcagt gtgaaaaaac aaaaagcgtt agtagcaaaa
3721 gtgtctcaga gggaagagat ggttaaaaaa tgtcttggag aacttacaga agtctgcaaa
3781 tctctgggga aagtttttgg tgtccattac ttcaatattt ttaataccgt cactctcaag
3841 aagcttgcag aatctttatc ttctgatcct gaggttttgc ttcaaattga tggtgttact
3901 gaagacaaac tggaaaaata tggtgcggaa gtgatttcag tattacagaa atactctgaa
3961 tggacatcgc cagctgaaga cagttcccca gggataagcc tgtccagcag cagaggcccc
4021 ggaagaagtg ccgctgagga gctcgacgag gaaatacccg tatcttccca ctactttgca
4081 agtaaaacca gaaatgaaag gaagaggaaa aagatgccag cctcccaaag gtctaagagg
4141 agaaaaactg cttccagtgg ttccaaggca aagggggggt ctgccacatg tagaaagata
4201 tcttccaaaa cgaaatcctc cagcatcatt ggatccagtt cagcctcaca tacttctcaa
4261 gcgacatcag gagccaatag caaattgggg attatggctc caccgaagcc tataaataga
4321 ccgtttctta agccttcata tgcattctca *taa*caaccga atctcaatgt acatagaccc
4381 tctttcttgt ttgtcagcat ctgaccatct gtgactataa agctgttatt cttgttatac
4441 catttgaagt ttttactcgt ctctattaat atttaaataa atgctggggg gtgatagttc
4501 ttctttttaa aataaacatt ttcttttgaa taagcatgtt ttgctgccgc tgcaagtgtt
4561 gtggccgttg tttctcagaa cgtctgaggc agcagctgaa tcatctcagt gcaagagctt
4621 ctgagcataa cacgaaaccc agaagccaaa ggaagagcca cgcgtgggcc cttgtgaaac
4681 taaagctttt cgtgtaagac aacacaaaca aaatttaaag acaaatgacg gggaaaagag
4741 gagaaaatat attacaaagg attagtatcc atcataccaa atacccgtga accagtcaga
4801 aacatcccag ggggcaggtg gaccaaggat gtgaacaggc tagtctcaga agaagaaata
4861 cacatgctca tggcccggca ctgtggctca cgcctgggat cccagcactt tgggaggccg FIG. 24A (continued)

4921 aggcaggtgg atcacgaggt caggagtttg agaccagcct gcccaacatg gtgaaacccc
4981 gtctctacta aaaatacaaa aattagccag gcgtggtgta caggcacgcc tgtagtccca
5041 gctactcagg aggctgaggc aagagaatcg cttgaaccca ggaggcggag gttgcagtga
5101 gccgagatcg tgccactgca ctccagcctg ggtgacagag caagactccg tctcaaaaaa
5161 aaaaaaaaaa aaagaaatat acatgctctg caaatatgtg aaaaaggtca atctccatga
5221 ataaaaatat gataaaacca

FIG. 24A (continued)

*atg*gctgctgttcctcaaaataatctacaggagcaactagaacgtcactcagccagaacacttaataataaattaagtctt
tcaaaaccaaaattttcaggtttcacttttaaaaagaaaacatcttcagataacaatgtatctgtaactaatgtgtcagtagc
aaaaacacctgtattaagaaataaagatgttaatgttaccgaagacttttccttcagtgaacctctacccaacaccacaa
atcagcaaagggtcaaggacttctttaaaaatgctccagcaggacaggaaacacagagaggtggatcaaaatcattat
tgccagatttcttgcagactccgaaggaagttgtatgcactacccaaaacacaccaactgtaaagaaatcccgggatac
tgctctcaagaaattagaatttagttcttcaccagattctttaagtaccatcaatgattgggatgatatggatgactttgatactt
ctgagacttcaaaatcatttgttacaccaccccaaagtcactttgtaagagtaagcactgctcagaaatcaaaaaagggt
aagagaaactttttaaagcacagctttatacaacaaacacagtaaagactgatttgcctccaccctcctctgaaagcga
gcaaatagatttgactgaggaacagaaggatgactcagaatggttaagcagcgatgtgatttgcatcgatgatggcccc
attgctgaagtgcatataaatgaagatgctcaggaaagtgactctctgaaaactcatttggaagatgaaagaggtcccgt
ggctgtcatcagtggtgaggaggactcagccagcccactgcaccacatcaaccacggcatcaccacgccctcgtcact
ggatgccgggcccgacactgtggtcattggcatgactcgcatccctgtcattgagaacccccagtacttccgtcagggac
acaactgccacaagccggacacgtatgtgcagcacattaagaggagagacatcgtgctgaagcgagaactgggtga
gggagcctttggaaaggtcttcctggccgagtgctacaacctcagcccgaccaaggacaagatgcttgtggctgtgaag
gccctgaaggatcccaccctggctgcccggaaggatttccagagggaggccgagctgctcaccaacctgcagcatga
gcacattgtcaagttctatggagtgtgcggcgatggggacccccctcatcatggtctttgaatacatgaagcatggagacct
gaataagttcctcagggcccatgggccagatgcaatgatccttgtggatggacagccacgccaggccaagggtgagct
ggggctctcccaaatgctccacattgccagtcagatcgcctcgggtatggtgtacctggcctcccagcactttgtgcaccg
agacctggccaccaggaactgcctggttggagcgaatctgctagtgaagattggggacttcggcatgtccagagatgtc
tacagcacggattattacagggtgggaggacacaccatgctccccattcgctggatgcctcctgaaagcatcatgtacc
ggaagttcactacagagagtgatgtatggagcttcggggtgatcctctgggagatcttcacctatggaaagcagccatgg
ttccaactctcaaacacggaggtcattgagtgcattacccaaggtcgtgttttggagcggccccgagtctgccccaaaga
ggtgtacgatgtcatgctggggtgctggcagagggaaccacagcagcggttgaacatcaaggagatctacaaaatcct
ccatgctttggggaaggccaccccaatctacctggacattcttggctag

FIG. 24B

MAAVPQNNLQEQLERHSARTLNNKLSLSKPKFSGFTFKKKTSSDNNVSVTNVSVAKT
PVLRNKDVNVTEDFSFSEPLPNTTNQQRVKDFFKNAPAGQETQRGGSKSLLPDFLQ
TPKEVVCTTQNTPTVKKSRDTALKKLEFSSSPDSLSTINDWDDMDDFDTSETSKSFV
TPPQSHFVRVSTAQKSKKGKRNFFKAQLYTTNTVKTDLPPPSSESEQIDLTEEQKDD
SEWLSSDVICIDDGPIAEVHINEDAQESDSLKTHLEDERGPVAVISGEEDSASPLHHIN
HGITTPSSLDAGPDTVVIGMTRIPVIENPQYFRQGHNCHKPDTYVQHIKRRDIVLKREL
GEGAFGKVFLAECYNLSPTKDKMLVAVKALKDPTLAARKDFQREAELLTNLQHEHIVK
FYGVCGDGDPLIMVFEYMKHGDLNKFLRAHGPDAMILVDGQPRQAKGELGLSQMLH
IASQIASGMVYLASQHFVHRDLATRNCLVGANLLVKIGDFGMSRDVYSTDYYRVGGH
TMLPIRWMPPESIMYRKFTTESDVWSFGVILWEIFTYGKQPWFQLSNTEVIECITQGR
VLERPRVCPKEVYDVMLGCWQREPQQRLNIKEIYKILHALGKATPIYLDILG

FIG. 24C

1 aagtgccgtt tcggtttaat ctagtgtgtg actgggtctg tgtgagggag agagtgtgtg
61 tggtgtggag gtgaaacgga ggcaagaaag ggggctacct caggagcgag ggacaaaggg
121 ggcgtgaggc acctaggccg cggcaccccg gcgacaggaa gccgtcctga accgggctac
181 cgggtagggg aagggcccgc gtagtcctcg cagggcccca gagctggagt cggctccaca
241 gccccgggcc gtcggcttct cacttcctgg acctccccgg cgcccgggcc tgaggactgg
301 ctcggcggag ggagaagagg aaacagactt gagcagctcc ccgttgtctc gcaactccac
361 tgccgaggaa ctctcatttc ttccctcgct ccttcacccc ccacctcatg tagaagggtg
421 ctgaggcgtc gggagggagg aggagcctgg gctaccgtcc ctgccctccc cacccccttc
481 ccggggcgct ttggtgggcg tggagttggg gttggggggg tgggtggggg ttgctttttg
541 gagtgctggg gaactttttt cccttcttca ggtcagggga aaggga*atg*c ccaattcaga
601 gagacatggg ggcaagaagg acgggagtgg aggagcttct ggaactttgc agccgtcatc
661 gggaggcggc agctctaaca gcagagagcg tcaccgcttg gtatcgaagc acaagcggca
721 taagtccaaa cactccaaag acatggggtt ggtgaccccc gaagcagcat ccctgggcac
781 agttatcaaa cctttggtgg agtatgatga tatcagctct gattccgaca ccttctccga
841 tgacatggcc ttcaaactag accgaaggga gaacgacgaa cgtcgtggat cagatcggag
901 cgaccgcctg cacaaacatc gtcaccacca gcacaggcgt tcccgggact tactaaaagc
961 taaacagacc gaaaaagaaa aaagccaaga agtctccagc aagtcgggat cgatgaagga
1021 ccggatatcg ggaagttcaa agcgttcgaa tgaggagact gatgactatg ggaaggcgca
1081 ggtagccaaa agcagcagca aggaatccag gtcatccaag ctccacaagg agaagaccag
1141 gaaagaacgg gagctgaagt ctgggcacaa agaccggagt aaaagtcatc gaaaaaggga
1201 aacacccaaa agttacaaaa cagtggacag cccaaaacgg agatccagga gcccccacag
1261 gaagtggtct gacagctcca aacaagatga tagcccctcg ggagcttctt atggccaaga
1321 ttatgacctt agtccctcac gatctcatac ctcgagcaat tatgactcct acaagaaaag
1381 tcctggaagt acctcgagaa ggcagtcggt cagtcccccct tacaaggagc cttcggccta
1441 ccagtccagc acccggtcac cgagccccta cagtaggcga cagagatctg tcagtcccta
1501 tagcaggaga cggtcgtcca gctacgaaag aagtggctct tacagcgggc gatcgcccag
1561 tccctatggt cgaaggcggt ccagcagccc tttcctgagc aagcggtctc tgagtcggag
1621 tccactcccc agtaggaaat ccatgaagtc cagaagtaga agtcctgcat attcaagaca
1681 ttcatcttct catagtaaaa agaagagatc cagttcacgc agtcgtcatt ccagtatctc
1741 acctgtcagg cttccactta attccagtct gggagctgaa ctcagtagga aaaagaagga
1801 aagagcagct gctgctgctg cagcaaagat ggatggaaag gagtccaagg gttcacctgt
1861 atttttgcct agaaaagaga acagttcagt agaggctaag gattcaggtt tggagtctaa
1921 aaagttaccc agaagtgtaa aattggaaaa atctgcccca gatactgaac tggtgaatgt
1981 aacacatcta aacacagagg taaaaaattc ttcagataca gggaaagtaa agttggatga
2041 gaactccgag aagcatcttg ttaaagattt gaaagcacag ggaacaagag actctaaacc
2101 catagcactg aaagaggaga ttgttactcc aaaggagaca gaaacatcag aaaaggagac
2161 ccctccacct cttcccacaa ttgcttctcc cccacccct ctaccaacta ctacccctcc
2221 acctcagaca cccccctttgc cacctttgcc tccaatacca gctcttccac agcaaccacc
2281 tctgcctcct tctcagccag catttagtca ggttcctgct tccagtactt caactttgcc
2341 cccttctact cactcaaaga catctgctgt gtcctctcag gcaaattctc agccccctgt
2401 acaggtttct gtgaagactc aagtatctgt aacagctgct attccacacc tgaaaacttc
2461 aacgttgcct cctttgcccc tcccaccctt attacctgga gatgatgaca tggatagtcc

FIG. 25

2521 aaaagaaact cttccttcaa aacctgtgaa gaaagagaag gaacagagga cacgtcactt
2581 actcacagac cttcctctcc ctccagagct ccctggtgga gatctgtctc ccccagactc
2641 tccagaacca aaggcaatca caccacctca gcaaccatat aaaaagagac caaaaatttg
2701 ttgtcctcgt tatggagaaa gaagacaaac agaaagcgac tgggggaaac gctgtgtgga
2761 caagtttgac attattggga ttattggaga aggaacctat ggccaagtat ataaagccaa
2821 ggacaaagac acaggagaac tagtggctct gaagaaggtg agactagaca atgagaaaga
2881 gggcttccca atcacagcca ttcgtgaaat caaaatcctt cgtcagttaa tccaccgaag
2941 tgttgttaac atgaaggaaa ttgtcacaga taaacaagat gcactggatt tcaagaagga
3001 caaaggtgcc ttttaccttg tatttgagta tatggaccat gacttaatgg gactgctaga
3061 atctggtttg gtgcactttt ctgaggacca tatcaagtcg ttcatgaaac agctaatgga
3121 aggattggaa tactgtcaca aaaagaattt cctgcatcgg gatattaagt gttctaacat
3181 tttgctgaat aacagtgggc aaatcaaact agcagatttt ggacttgctc ggctctataa
3241 ctctgaagag agtcgccctt acacaaacaa agtcattact ttgtggtacc gacctccaga
3301 actactgcta ggagaggaac gttacacacc agccatagat gtttggagct gtggatgtat
3361 tcttggggaa ctattcacaa agaagcctat tttcaagcc aatctggaac tggctcagct
3421 agaactgatc agccgacttt gtggtagccc ttgtccagct gtgtggcctg atgttatcaa
3481 actgccctac ttcaacacca tgaaaccgaa gaagcaatat cgaaggcgtc tacgagaaga
3541 attctctttc attccttctg cagcacttga tttattggac cacatgctga cactagatcc
3601 tagtaagcgg tgcacagctg aacagaccct acagagcgac ttccttaaag atgtcgaact
3661 cagcaaaatg gctcctccag acctccccca ctggcaggat tgccatgagt tgtggagtaa
3721 gaaacggcga cgtcagcgac aaagtggtgt tgtagtcgaa gagccacctc catccaaaac
3781 ttctcgaaaa gaaactacct cagggacaag tactgagcct gtgaagaaca gcagcccagc
3841 accacctcag cctgctcctg gcaaggtgga gtctggggct ggggatgcaa taggccttgc
3901 tgacatcaca caacagctga atcaaagtga attggcagtg ttattaaacc tgctgcagag
3961 ccaaaccgac ctgagcatcc ctcaaatggc acagctgctt aacatccact ccaacccaga
4021 gatgcagcag cagctggaag ccctgaacca atccatcagt gccctgacgg aagctacttc
4081 ccagcagcag gactcagaga ccatggcccc agaggagtct ttgaaggaag caccctctgc
4141 cccagtgatc ctgccttcag cagaacagac gacccttgaa gcttcaagca caccagctga
4201 catgcagaat atattggcag ttctcttgag tcagctgatg aaaacccaag agccagcagg
4261 cagtctggag gaaaacaaca gtgacaagaa cagtgggcca caggggcccc gaagaactcc
4321 cacaatgcca caggaggagg cagcagagaa gaggcccccct gagccccccg gacctccacc
4381 gccgccacct ccacccccctc tggttgaagg cgatctttcc agcgcccccc aggagttgaa
4441 cccagccgtg acagccgcct tgctgcaact tttatcccag cctgaagcag agcctcctgg
4501 ccacctgcca catgagcacc aggccttgag accaatggag tactccaccc gaccccgtcc
4561 aaacaggact tatggaaaca ctgatgggcc tgaaacaggg ttcagtgcca ttgacactga
4621 tgaacgaaac tctggtccag ccttgacaga atccttggtc cagaccctgg tgaagaacag
4681 gaccttctca ggctctctga gccaccttgg ggagtccagc agttaccagg gcacagggtc
4741 agtgcagttt ccaggggacc aggacctccg ttttgccagg gtccccttag cgttacaccc
4801 ggtggtcggg caaccattcc tgaaggctga gggaagcagc aattctgtgg tacatgcaga
4861 gaccaaattg caaaactatg gggagctggg gccaggaacc actggggcca gcagctcagg
4921 agcaggcctt cactgggggg gcccaactca gtcttctgct tatggaaaac tctatcgggg
4981 gcctacaaga gtcccaccaa gagggggaag agggagagga gttccttac*t aa*cccagaga
5041 cttcagtgtc ctgaaagatt cctttcctat ccatccttcc atccagttct ctgaatcttt FIG. 25 (continued)

5101 aatgaaatca tttgccagag cgaggtaatc atctgcattt ggctactgca aagctgtccg
5161 ttgtattcct tgctcacttg ctactagcag gcgacttacg aaataatgat gttggcacca
5221 gttccccctg gatgggctat agccagaaca tttacttcaa ctctacctta gtagatacaa
5281 gtagagaata tggagaggat cattacattg aaaagtaaat gttttattag ttcattgcct
5341 gcacttactg atcggaagag agaaagaaca gtttcagtat tgagatggct caggagaggc
5401 tctttgattt ttaaagtttt ggggtggggg attgtgtgtg gtttctttct tttgaatttt
5461 aatttaggtg ttttgggttt ttttccttta aagagaatag tgttcacaaa atttgagctg
5521 ctctttggct tttgctataa gggaaacaga gtggcctggc tgatttgaat aaatgtttct
5581 ttcctctcca ccatctcaca ttttgctttt aagtgaacac tttttcccca ttgagcatct
5641 tgaacatact ttttttccaa ataaattact catccttaaa gtttactcca ctttgacaaa
5701 agatacgccc ttctccctgc acataaagca ggttgtagaa cgtggcattc ttgggcaagt
5761 aggtagactt tacccagtct ctttcctttt ttgctgatgt gtgctctctc tctctctttc
5821 tctctctctc tctctctctc tctctctctc tctctctctg tctcgcttgc tcgctctcgc
5881 tgtttctctc tctttgaggc atttgtttgg aaaaaatcgt tgagatgccc aagaacctgg
5941 gataattctt tactttttttt gaaataaagg aaaggaaatt cagactctta cattgttctc
6001 tgtaactctt caattctaaa atgttttgtt ttttaaacca tgttctgatg gggaagttga
6061 tttgtaagtg tggacagctt ggacattgct gctgagctgt ggttagagat gatgcctcca
6121 ttcctagagg gctaataaca gcatttagca tattgtttac acatatattt ttatgtcaaa
6181 aaaaaaacaa aaacctttca aacagagcat tgtgatattg tcaaagagaa aaacaaatcc
6241 tgaagataca tggaaatgta acctagttta gggtgggtat ttttctgaag atacatcaat
6301 acctgacctt ttttaaaaaa ataattttaa aacagcatac tgtgaggaag aacagtattg
6361 acatacccac atcccagcat gtgtaccctg ccagttcttt tagggatttt tcctccaaag
6421 agatttggat ttggttttgg taaaaggggt taaattgtgc ttccaggcaa gaactttgcc
6481 ttatcataaa caggaaatga aaaagggaag ggctgtcagg atgggataat ttgggaggct
6541 tctcattctg gcttctattt ctatgtgagt accagcatat agagtgtttt aaaaacagat
6601 acatgtcata taatttatct gcacagactt agaccttcag gaaacatagg ttaagccccc
6661 ttttacaaag aaaaagtaaa catacttcag catcttggag ggtagttttc aaaactcaag
6721 tttcatgttt caatgccaag ttcttatttt aaaaaataaa atctacttat aagagaaagg
6781 tgcattactt aaaaaaaaaa aactttaaag aaatgaaaga agaaccctct tcagatactt
6841 acttgaagac tgttttcccc tgttaatgag atatagctag atatcggtgt gtgtatttct
6901 ttattattct ctggtttttg atctggcctt gcctccaggg ccaaacactg atttagaaag
6961 agagccttct agctattttg gcattgatgg ctttttatac cagtgtgtcc agttagattt
7021 actaggctta ctgacatgct attggtaaat cgcattaaag ttcatctgaa ccttctgtct
7081 gttgacttct tagtcctcag acatgggcct ttgtgtttta gaatatttga atttgagtta
7141 ttgggcccca ctccctgttt tttattaaag aacgtgagcc tgggatactt tcagaagtat
7201 ctgttcaatg aaaaaaagtt ggtttcccat caaatatgaa taaaattctc tatatatttc
7261 attgtatttt ggttatcagc agtcatcaat aatgtttttc cctcccctct cccacctctt
7321 atttttaatt atgccaaata tcctaaataa tatacttaag cctccattcc ctcatcccta
7381 ctagggaagg gggtgagtgt atgtgtgagt gtatgtgtat gtatgatccc atctcacccc
7441 cacccccatt ttgggagtct tttaaaatga aaacaaagtt tggtagtttt gactatttct
7501 aaaagcagag gagaaaaaaa aacttattta aatatcctgg aatctgtatg gaggaagaaa
7561 aggtatttgt taatttttca gttacgttat ctataaacat gatggaagta aaggtttggc FIG. 25 (continued)

7621 agaatttcac cttgactatt tgaaaattac agacccaatt aattccattc aaaagtggtt
7681 ttcgttttgt tttaattatt gtacaatgag agatattgtc tattaaatac attattttga
7741 acagatgaga aatctgattc tgttcatgag tgggaggcaa aactggtttg accgtgatca
7801 tttttgtggt tttgaaaaca aatatacttg acccagtttc cttagttttt tcttcaactg
7861 tccataggaa cgataagtat ttgaaagcaa catcaaatct atacgtttaa agcagggcag
7921 ttagcacaaa tttgcaagta gaacttctat tagcttatgc catagacatc acccaaccac
7981 ttgtatgtgt gtgtgtatat ataatatgca tatatagtta ccgtgctaaa atggttacca
8041 gcaggttttg agagagaatg ctgcatcaga aaagtgtcag ttgccacctc attctccctg
8101 atttaggttc ctgacactga ttcctttctc tctcgttttt gacccccatt gggtgtatct
8161 tgtctatgta cagatatttt gtaatatatt aaattttttt ctttcagttt ataaaaatgg
8221 aaagtggaga ttggaaaatt aaatatttcc tgttactata ccacttttgc tccattgcat
8281 t

FIG. 25 (continued)

1 agccggcccc gccccctggc gcgcgggcgt gtcggacccg cagagctctc ggactttcgg
61 aagctctcgg tgtgggtgcg acccgagaga aggagcgggg ctggtggggc tgctgcagcc
121 gtcacaggaa ataagtaatc *atg*gtgctca acagtttgga taagatgatt caactccaga
181 aaaacactgc caacatcagg aatatttgtg ttttggctca tgttgaccat ggaaaaacta
241 ctctggctga ctgtcttata tctagcaatg gaatcatctc cagccgccta gcaggcaagt
301 taaggtacat ggacagcaga gaagatgaac agatccgagg gatcactatg aaatccagtg
361 ccatttccct acattatgca acaggtaatg aggagtacct gatcaatctg atagactctc
421 caggacacgt ggacttttcc tcagaagtat caaccgctgt tcgcatttgt gatggatgca
481 tcattgtggt agatgctgtg gaaggagtct gtccacagac acaggcagtt ctgcgacaag
541 cttggcttga aaacatccgt ccggttttag tgattaataa gattgatcgc ttgatagtgg
601 aactgaaatt caccccacaa gaggcctatt ctcacctcaa gaatatttta gaacagatta
661 atgcgctcac agggactctt tttacttcta aagtcctaga agaaagagca gagagggaga
721 ctgaatccca agtgaatcca aattctgaac aaggagagca agtatatgac tggagcactg
781 gcttggagga cacagatgat tctcaccttt acttctctcc agaacaggga aatgtggtgt
841 ttaccagtgc aatagatggg tggggctttg gaattgagca cttcgccaga atctacagtc
901 aaaaaattgg catcaaaaag gaagttctta tgaaaacctt gtggggagat tactatataa
961 atatgaaggc taaaaagatc atgaagggtg atcaggccaa aggaaagaaa cctttatttg
1021 tacagttgat cctggaaaat atatggagtt tgtatgatgc tgttttgaaa aaggacaaag
1081 acaaaattga taaaatagtg acttctttag gattaaaaat tggagcccgg gaggcacgac
1141 attcagaccc taaagttcag atcaacgcca tttgcagtca gtggctaccc atatcccatg
1201 ctgttcttgc tatggtgtgt cagaaacttc ctagtcccct tgatattaca gctgagagag
1261 tggagagact gatgtgcaca ggatcacaaa cttttgactc ttttccacca gaaactcaag
1321 cactgaaagc agcttttatg aaatgtggaa gtgaggacac tgctccagtt attatatttg
1381 tttccaaaat gtttgcagtt gatgctaagg ccttgcctca gaataagcca aggcctctca
1441 ctcaagaaga aattgctcag agacgtgagc gtgcaagaca aaggcatgca gagaagcttg
1501 cagcagcaca gggacaggca cccttggagc ccacccaaga tgggagtgcc attgaaacat
1561 gtccaaaagg agaggagcca agaggtgacg agcaacaggt ggaaagtatg acccctaaac
1621 ctgtgctcca ggaagaaaac aaccaagagt cttttattgc atttgctcgg gtgttcagtg
1681 gtgtggctcg aagaggaaag aaaatttttg tcttggggcc caaatacagt cctcttgagt
1741 ttttacgaag ggtaccatta ggcttctcag ctccaccaga tggcctcccc caagtccccc
1801 acatggcata ctgtgctctg gaaaacctgt atcttctgat gggaagggaa ctggaatatc
1861 tagaggaggt acctccagga aatgtgctag gaataggagg ccttcaagat tttgtgctga
1921 aatctgcaac actgtgtagc ctgccatcct gcccaccatt tataccactc aacttcgaag
1981 ccactcctat tgtgagagtt gctgttgaac caaaacatcc aagtgaaatg cctcagctcg
2041 taaaaggaat gaaactgtta aaccaggctg atccctgtgt ccagatttta attcaggaaa
2101 cgggagagca cgttttagtc acagcaggag aagtccacct tcagcgatgc ctggatgact
2161 taaaagaaag gtttgcaaag attcatatca gtgtatctga acctattatt ccattcagag
2221 aaacaatcac aaaacccccca aaagttgaca tggtcaatga agaaataggc aaacagcaaa
2281 aagttgcagt catacaccaa atgaaagaag atcaaagcaa aatccctgaa ggaatccaag
2341 ttgactctga cgggctaatc accataacaa ctcccaataa acttgccacg ctcagtgttc
2401 gagccatgcc ccttccagaa gaagtcaccc agattctgga agaaaatagt gatttgattc

FIG. 26

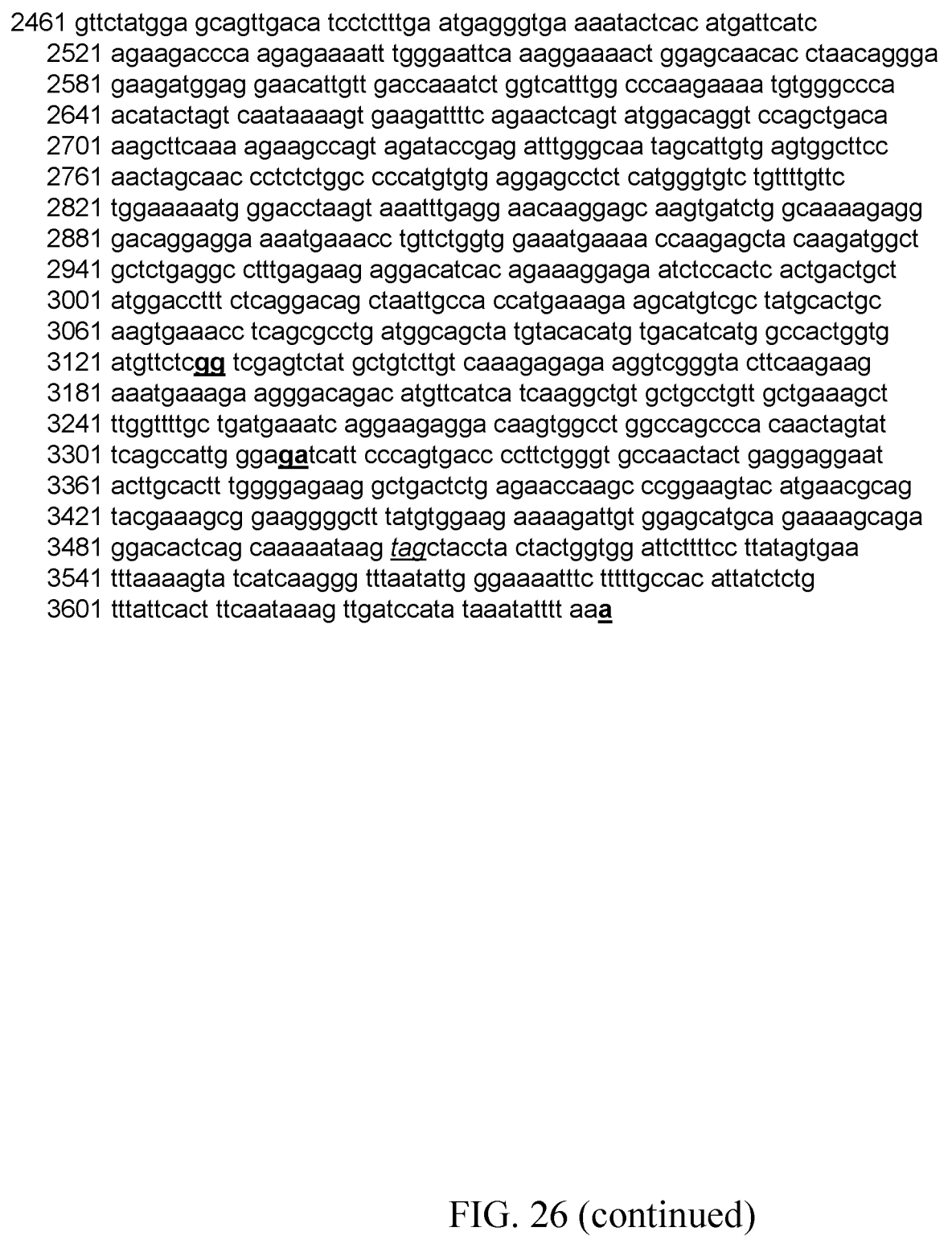

2461 gttctatgga gcagttgaca tcctctttga atgagggtga aaatactcac atgattcatc
2521 agaagaccca agagaaaatt tgggaattca aaggaaaact ggagcaacac ctaacaggga
2581 gaagatggag gaacattgtt gaccaaatct ggtcatttgg cccaagaaaa tgtgggccca
2641 acatactagt caataaaagt gaagattttc agaactcagt atggacaggt ccagctgaca
2701 aagcttcaaa agaagccagt agataccgag atttgggcaa tagcattgtg agtggcttcc
2761 aactagcaac cctctctggc cccatgtgtg aggagcctct catgggtgtc tgttttgttc
2821 tggaaaaatg ggacctaagt aaatttgagg aacaaggagc aagtgatctg gcaaaagagg
2881 gacaggagga aaatgaaacc tgttctggtg gaaatgaaaa ccaagagcta caagatggct
2941 gctctgaggc ctttgagaag aggacatcac agaaaggaga atctccactc actgactgct
3001 atggaccttt ctcaggacag ctaattgcca ccatgaaaga agcatgtcgc tatgcactgc
3061 aagtgaaacc tcagcgcctg atggcagcta tgtacacatg tgacatcatg gccactggtg
3121 atgttctcgg tcgagtctat gctgtcttgt caaagagaga aggtcgggta cttcaagaag
3181 aaatgaaaga agggacagac atgttcatca tcaaggctgt gctgcctgtt gctgaaagct
3241 ttggttttgc tgatgaaatc aggaagagga caagtggcct ggccagccca caactagtat
3301 tcagccattg ggagatcatt cccagtgacc ccttctgggt gccaactact gaggaggaat
3361 acttgcactt tggggagaag gctgactctg agaaccaagc ccggaagtac atgaacgcag
3421 tacgaaagcg gaaggggctt tatgtggaag aaaagattgt ggagcatgca gaaaagcaga
3481 ggacactcag caaaaataag *tag*ctaccta ctactggtgg attcttttcc ttatagtgaa
3541 tttaaaagta tcatcaaggg tttaatattg ggaaaatttc tttttgccac attatctctg
3601 tttattcact ttcaataaag ttgatccata taaatatttt aaa

FIG. 26 (continued)

1 *atg*ccgcggc cggggaagag ctcgtacagc gaccaaaaac cgccctactc ttacatctcg
61 ctgaccgcca tggcaatcca gcactcggcc gagaagatgc tgccgctgag cgacatctac
121 aagttcatca tggagcgctt cccctactac cgcgagcaca cacagcgctg gcagaacagc
181 ctgcgccaca acctctcctt caacgactgc ttcatcaaga ttccgcggag gcccgaccag
241 cctggcaagg gtagcttctg ggcgctgcac cccgactgcg gggacatgtt cgagaacggc
301 agcttcctgc ggcgtcgcaa gcgcttcaag gtgctgcgcg ccgaccatac tcacttgcac
361 gcgggaagca ccaagagcgc gccgggcgcc ggtccgggag ggcaccttca cccccatcac
421 caccaccacc cccaccacca ccatcatcac cacgctgccg cacaccacca ccatcaccac
481 cacccacccc agccgccgcc gccgccgccc ccgccgccgc cgcacatggt acactatttc
541 catcagcaac cgcctactgc tccgcagccg cctccgcacc tcccgtcaca gcccccgcag
601 caaccgcccc agcagtcgca gcctcagcag ccgtctcacc ccggcaagat gcaggaggcg
661 gcggccgtgg cggcggcggc ggcggcggcc gcggcagccg cggtgggcag cgtgggacgc
721 ctgtctcagt tcccacccta cgggctgggc tcggccgccg ccgctgccgc cgcggccgcg
781 gcgtccacgt caggcttcaa gcaccccttt gccattgaga acattattgg ccgggactac
841 aagggcgtgc tgcaggctgg agggctgccc ttggcgtccg tcatgcacca cctgggctac
901 cccgtgcccg gccagcttgg caacgtcgtc agctccgtgt ggccgcacgt tggcgtcatg
961 gattcggtgg ccgccgccgc ggccgccgca gccgcagccg gagtccctgt aggcccggag
1021 tatggggcct tcggggtccc ggtcaagtcc ctgtgccact cggcaagcca gagcctgcct
1081 gccatgccgg tgcccatcaa gcccacgcct gcgctgccgc ccgtgtccgc gctgcagccg
1141 gggctcactg tccccgcggc ttcgcagcag cctccggcgc catccaccgt gtgctccgcg
1201 gccgcggcct cgcccgttgc ctctctgctg gagcccacag cccctacctc ggccgaaagc
1261 aagggcggct ccttgcactc ggtgctagtg cactcc*ta**g*

FIG. 27

1 agacggcggt gggacggcca ggccccggcc ccgccagtgt gtccgcccgg ccccgcgtcc
61 cggagcgccc gcacccggcc ccgccgccgc ctcagagcaa gaaagctttc tgctcagcca
121 tggctacgag tccacgcctt aatgcacccc acagccagcg gcagtggcag tgacaacagc
181 gggacctgcc tttgaagatc ggctgctgca agggttg*atg* gctggcatgt cgcaaagacc
241 ccccagcatg tactggtgtg tggggccgga ggagtcagct gtgtgtccag aacgtgccat
301 ggagacgctt aacggtgccg gggacacggg cggcaagccg tccacgcggg gcggtgaccc
361 tgcagcgcgg tcccgcagga cggaaggcat ccgcgccgcg tacaggcggg gagaccgcgg
421 cggcgcccgg gacctgctgg aggaggcctg cgaccagtgc gcgtcccagc tggaaaaggg
481 ccagcttctg agcatcccgg cagcctatgg ggatctggag atggtccgct acctactcag
541 caagagactg gtggagctgc ccaccgagcc cacggatgac aacccagccg tggtggcagc
601 gtattttgga cacacggcag ttgtgcagga attgcttgag tccttaccag gtccctgcag
661 tccccagcgg cttctgaact ggatgctggc cttggcttgc cagcgagggc acctgggggt
721 tgtgaagctc ctggtcctga cgcacggggc tgacccggag agctacgctg tcaggaagaa
781 tgagttccct gtcatcgtgc gcttgcccct gtatgcggcc atcaagtcag ggaatgaaga
841 cattgcaata ttcctgcttc ggcatggggc ctatttctgt tcctacatct tgctggatag
901 tcctgacccc agcaaacatc tgctgagaaa gtacttcatt gaagccagtc ccttgcccag
961 cagttatccg ggaaaaacag ctctccgtgt gaaatggtcc catctcagac tgccctgggt
1021 agacctagac tggctcatag acatctcctg ccagatcacg gagctcgacc tttctgccaa
1081 ctgcctggcg accctcccct cggttatccc ctggggcctc atcaatctcc ggaagctgaa
1141 cctctccgac aaccacctgg gggagctgcc tggcgtgcag tcatcggacg aaatcatctg
1201 ttccaggcta cttgaaattg acatttccag caacaagttg tcccacctcc ctcctggatt
1261 cttgcacctc tcaaaacttc aaaaactgac agcttcaaaa aattgtttag aaaaattgtt
1321 cgaagaagaa aatgccacta actggatagg tttacggaag ctacaggaac ttgatatatc
1381 tgacaataaa ttgacagaac tccctgccct gttccttcac tctttcaagt ccctcaattc
1441 tctgaatgtc tccagaaaca acctgaaggt gtttccagat ccctgggcct gccctttgaa
1501 atgttgtaaa gcttccagaa atgccctgga atgtctgcca gacaaaatgg ctgtcttttg
1561 gaaaaatcac ctgaaggatg tggatttctc agaaaacgca ctcaaagaag ttcccctggg
1621 acttttccag cttgatgccc tcatgttctt gaggttacag gggaaccagc tggcggcact
1681 tccacctcaa gagaagtgga cctgcaggca gctcaaaacc ctggatctct ccagaaacca
1741 acttggcaaa aatgaagatg gactgaaaac gaagcgtatt gcctttttca ccaccagagg
1801 tcgccagcgc tccgggactg aggcagcaag tgtgctggaa tttccggcct tcctaagtga
1861 gtctttggaa gtcctttgcc tgaacgacaa ccacctcgac acagtccctc cctcggtttg
1921 cctactgaag agcttatcag agctctactt gggaaacaac cctggcctcc gggagctccc
1981 tcctgagctg gggcagctgg gcaacctctg gcagctggac actgaagacc tgaccatcag
2041 caatgtgcct gcagaaatcc aaaaagaagg ccccaaagca atgctgtctt acctgcgtgc
2101 tcagctgcgg aaagcggaaa agtgcaagct gatgaagatg atcatcgtgg gtcccccgcg
2161 ccagggcaag tccaccctcc tggagatctt acagacgggg agggcccccc aggtggtgca
2221 tggagaggcc accatcagga ccaccaagtg ggagctccag aggccggctg gctcgagagc
2281 caaggttgag tccgtggagt tcaacgtctg ggacatcggg ggaccggcca gcatggccac
2341 tgtcaaccag tgcttcttca cggacaaggc cctgtacgtg gtggtctgga acctggcgct
2401 gggggaggag gccgtggcca acctccagtt ctggctgctc aacatcgagg ccaaggcccc

FIG. 28A 2461 aaacgccgtg gtgctggtgg tcgggacgca cctggattta attgaagcca agttccgtgt
2521 ggaaaggatt gcaacgctgc gtgcctatgt gctggcactc tgccgctccc cctccggctc
2581 cagggccaca ggcttcccag acatcacctt caaacactta catgagattt cctgcaagag
2641 cctggaaggt caggaagggc tgcgacagct gattttccac gtcacgtgca gcatgaagga
2701 cgtgggcagc accatcggct gccagcgact ggcagggcgg ctgatcccca ggagctacct
2761 gagcctgcag gaggccgtgc tggcagagca gcagcgccgc agccgggacg acgacgtgca
2821 gtacctgacg gacaggcagc tggagcagct ggtggagcag acgcccgaca acgacatcaa
2881 ggactacgag gacctgcagt cagccatcag cttcctcata gaaaccggca ccctgctcca
2941 tttcccggac accagccacg gcctgaggaa cctctacttc ctcgacccta tttggctctc
3001 cgaatgtctg cagaggatct ttaatattaa gggctctcgg tcagtggcca agaatggggt
3061 gatcagagca gaagacctca ggatgctgct ggtggggact ggcttcacgc agcagacgga
3121 agagcagtac ttccagttcc tggccaagtt tgagatcgcc ctgcccgtcg ccaatgacag
3181 ctacctcctg ccccatctcc ttccatctaa acctggcctg gacacccacg gtatgcggca
3241 ccccacagcc aacaccattc agagggtatt taagatgagc ttcgttcccg ttggcttctg
3301 gcaaaggttt atagcacgga tgctgatcag cctggcggag atggacctgc agctttttga
3361 aaacaagaag aatactaaaa gcaggaacag gaaagtcacc atttacagtt ttacaggaaa
3421 ccagagaaat cgctgtagca cattcagagt gaaaagaaat cagaccatct attggcagga
3481 agggctcctg gtcacttttg atgggggcta cctcagtgtg gaatcttccg acgtgaactg
3541 gaaaaagaag aaaagcggag gaatgaaaat tgtttgccaa tcagaagtga gggacttctc
3601 agccatggct ttcatcacgg accacgtcaa ttccttgatt gatcagtggt ttcccgccct
3661 gacagccaca gagagcgacg ggacgccact catggagcag tacgtgccct gcccggtctg
3721 cgagacagcc tgggcccagc acacggaccc cagtgagaaa tcagaggatg tgcagtactt
3781 cgacatggaa gactgtgtcc tgacggccat cgagcgggac ttcatctcct gccccagaca
3841 cccggacctc cccgtgccgc tgcaggagct ggtccctgaa ctgttcatga ccgacttccc
3901 ggccaggctc ttcctggaga acagcaagct ggagcacagc gaggacgagg gcagcgtcct
3961 gggccagggc ggcagtggca ccgtcatcta ccgggcccgg taccagggcc agcctgtggc
4021 cgtcaagcgc ttccacatca aaaaattcaa gaactttgct aacgtaccgg cagacaccat
4081 gctgaggcac ctgcgggcca ccgatgccat gaagaacttc tccgagttcc ggcaggaggc
4141 cagcatgctg cacgcgctgc agcacccctg catcgtggcg ctcatcggca tcagcatcca
4201 cccgctctgc ttcgccctgg agctcgcgcc gctcagcagc ctcaacaccg tgctgtccga
4261 gaacgccaga gattcttcct ttatacccct gggacacatg ctcacccaaa aaatagccta
4321 ccagatcgcc tcgggcctgg cctacctgca caagaaaaac atcatcttct gtgacctgaa
4381 gtcggacaac attctggtgt ggtcccttga cgtcaaggag cacatcaaca tcaagctatc
4441 tgactacggg atttcgaggc agtcattcca tgagggcgcc ctaggcgtgg agggcactcc
4501 tggctaccag gccccagaga tcaggcctcg cattgtatat gatgagaagg tagatatgtt
4561 ctcctatgga atggtgctct acgagttgct gtcaggacag cgccctgcac tgggccacca
4621 ccagctccag attgccaaga agctgtccaa gggcatccgc ccggttctgg ggcagccgga
4681 ggaagtgcag ttccggcgac tgcaggcgct catgatggag tgctgggaca ctaagccaga
4741 gaagcgaccg ctggccctgt cggtggtgag ccagatgaag gacccgactt ttgccacctt
4801 catgtatgaa ctgtgctgtg ggaagcagac agccttcttc tcatcccagg gccaggagta
4861 caccgtggtg ttttgggatg gaaaagagga gtccaggaac tacacggtgg tgaacacaga FIG. 28A (continued)

4921 gaagggcctc atggaggtgc agaggatgtg ctgccctggg atgaaggtga gctgccagct
4981 ccaggtccag agatccctgt ggacagccac cgaggaccag aaaatctaca tctacaccct
5041 caagggcatg tgccccttaa acacacccca acaggccttg gatactccag ctgtcgtcac
5101 ctgcttcttg gccgtgcctg ttattaaaaa gaattcctac ctggtcttag cgggcctcgc
5161 cgatgggctt gtggctgtgt ttcccgtggt gcggggcacc ccaaaggaca gctgctccta
5221 cctgtgctca cacacagcca acaggtccaa gttcagcatc gcggatgaag acgcacggca
5281 gaacccctac ccagtgaagg ccatggaggt ggtcaacagc ggctctgagg tctggtacag
5341 caatgggccg ggcctccttg tcatcgactg tgcctccctg gagatctgca ggcggctgga
5401 gccctacatg gccccctcca tggttacgtc agtcgtgtgc agctctgagg gcagagggga
5461 ggaggtcgtc tggtgcctgg atgacaaggc caactccttg gtgatgtacc actccaccac
5521 ctaccagctg tgtgcccggt acttctgcgg ggtccccagc cccctcaggg acatgtttcc
5581 cgtgcggccc ttggacacgg aacccccggc agccagccac acggccaacc caaaggtgcc
5641 tgagggggac tccatcgcgg acgtgagcat catgtacagt gaggagctgg gcacgcagat
5701 cctgatccac caggaatcac tcactgacta ctgctccatg tcctcctact cctcatcccc
5761 accccgccag gctgccaggt ccccctcaag cctccccagc tccccagcaa gttcttccag
5821 tgtgcctttc tccaccgact gcgaggactc agacatgcta catacgcccg gtgctgcctc
5881 cgacaggtct gagcatgacc tgacccccat ggacggggag accttcagcc agcacctgca
5941 ggccgtgaag atcctcgccg tcagagacct catttgggtc cccaggcgcg gtggagatgt
6001 tatcgtcatt ggcctggaga aggattctgg cgcccagcgg ggccgagtca ttgccgtctt
6061 aaaagcccga gagctgactc cgcatggggt gctggtggat gctgccgtgg tggcaaagga
6121 cactgttgtg tgcacctttg aaaatgaaaa cacagagtgg tgcctggccg tctggagggg
6181 ctggggcgcc agggagttcg acattttcta ccagtcctac gaggagctgg gccggctgga
6241 ggcttgcact cgcaagagaa gg*taa*ttcct gtggaatgac tgtcacacat cagagctggc
6301 tggcccgggg ctgcagcctg acccctctgc catcggcctc tagttctcca aggacctaga
6361 agacagatgg agttctcccc tgaactcctt gctgctaaga agtgctgaga agttactcgc
6421 ctggcggtgg ctccagggtt ctctggttct ctggagcaga gttctctgaa taccccatcc
6481 cccaactgct gattttacag ccccagggaa gacagtggta tcaggctggg agcggcctcc
6541 tctggcctcc cccatcagtt tgcaggagca ggggtgcagg atcctgttct gagctgggtc
6601 aaacaaagca gggccgggcc ttcctgccat ccccaggtct cagatggaat tacactagag
6661 gccctccgct gggaagcact tgaggtaggg caggaggggg gctgtgaccc ctgccctttc
6721 cccgccagag acctcaggct ctcagcacat tccacaggct cctgagtccc cgaggcctgg
6781 gccagcttgg gcaagccaag atcagatgtc tctgtgttcg ggaaggtctc cgtgtgggaa
6841 agcccttggg ggatcccggg tgaggagtgt tgccccatcc agagaatgaa tgagttcctt
6901 taagtgccac cgccagcaag cccagaggca cacagtccga gtgcacccgc ttagccttta
6961 cattcctctc caccgacaaa aggaagggga aactcaatca gcaggacttc agaaagggcc
7021 ttgtgtttat agctttgtca agtaaatttg gacgcagctg gagcacaggc cctgtttgtt
7081 tgcacataat aatcttgttt atcactttaa aaaattcagt aatatctcag cagtcaggct
7141 tctggttgtg aaatcacatt gtatgggatt tataccaaat tatgtatttg ctaaacattc
7201 actgcacacg tgtacagcgg agtacgaaaa ggaacgttgt ccacagggga tttatggata
7261 caacagcaaa cattttataa actatgcaca tgcattacac acatgcacac acatatgcac
7321 acacatgtgc aaacatagcc actttttgt caagagttac cctttggggc tccttaaacc FIG. 28A (continued)

7381 agaatgggag tttgaaagag agatcatact ccagctgaag tttgttgacc cttttctaaa
7441 attaaaaaga tcaaatttag tatttgctgg atatgcaggg agatgagact cttttaatct
7501 caaaataaac agattctttc aagaacgaag ctgtggcctc tgtcttttga gcgcttatga
7561 ccacagcacg ggctcagtcc ctcccagacc cactcgctgt ctggggataa tgggcagccc
7621 ctccttgccc actgtgccaa catgcaggtg gcccctgagc agcttccatg ggtggagacg
7681 ctgctctgtc agtcacaggc ttggaaaaag cgagtccccc cactcttttt tttttttttt
7741 tttttttttt taccaacctg ggcaccaagt cccagggggc tgagggtctg tgcttcctgt
7801 ctacctccct gccattctct caccctcatc ccacagcagg gtctcaggag tcccactctc
7861 cctctcctct cattccagtg ccccacaact gcccagttaa cccccagatg caagccagat
7921 tccatctgcc ccaggcccca agcttttgct ttggcatcac gcgaggccag gctgctttgc
7981 aggcaccaaa attcaccctc tcctactcct ggaaaagccc agccccaggc ctcacagagc
8041 caggggaggg gatctcatca catcacagtt agaaatcata caggcctaaa gtcccagcta
8101 cccaggagcc aaggcaggag gaacccttga gcctgggagt tggaggttac agtgagctat
8161 gatcacacca gctttctagc ctgggtgaca gagcaagacc caactcttaa aaaaaaaaaa
8221 aaaatacagg aaatgactaa tgaacttgac tccatgaaat tgaaacttac gtggaaaatt
8281 agtccaaagc ctaaaagact agcaactgag aaaaaaaaac attgcaacac aaatgagaga
8341 caaagacctc acttatcttc attacagaga gttcgtaatg tcaataagaa acagaaaacc
8401 ggaaaggcaa acaggttaag ggcatgggca gcaattgaat tacaaagaaa cagacagacc
8461 cttaaacatc aatgcttgac ctcacccaac agcagggaaa cagtctccac aacagtaaaa
8521 tgttgctggg atgggcccag cattcagcat ggtccctgca actttggcct ctgcccagtg
8581 acctctggcg ggtgtagaag agctcatgct tcagtgaggg ggtgggggc accctgagga
8641 ccctgtcaac atcagctgga ccacaggcat ctcagataga tgtcacttac caccctcatg
8701 ttggcagagg gtggtaacca gccagcatct ccttcttaaa cacctactaa gtgtcaggca
8761 ctgtgaccgg agacacagtc aagaatctct gtgttttttt tgttttgttt tgtttttgtt
8821 ttttgagacg gagtctcgct ctgttgccca ggctggagtg caatggcgcg atctcagctc
8881 actgccacct ccgcctccca ggttcaagca attctcctgc ctcagcctcc cgagtagctg
8941 cgattacagg cgtgcaccac aatgcctgga taatttttgt attttcagta gaaacggggt
9001 ttcaccatgt tggccaggat ggtcttgaac tcctgagctc aggtgatccg cccgcctcat
9061 cctcccaaag tgctgggatt acaggtgtga gctacctgcg ctggccgaat ctctgctttt
9121 aggagctcac tcctcatagg tagagttgac aataagcaca caaacaagtg agatagcagg
9181 gcagccggac cacccagttg ggcaattcgt ggcttggcct aggaacgtta catttgactg
9241 aggctggcga ggcctgcagc ctgcaccagg aggtacaatg tgagactgag gaatgggaag
9301 aaggcattcc atggagctct gagggcactg ggtgcaaggg ccttgcacat gcaaagaccc
9361 tgttgtgggt tcaagccact gtgtgggagg gacaggagag cctggcgtgg ctgcggcctt
9421 gaaggagggg actgtgcaca cagaattgca agtgggggtc tccgcggaag ctcctggcag
9481 ttttaagcag gattattaga tgattcagtc aactttacaa ctcactttgc tgaatggagg
9541 gtggattaac gagggggtag ttggaggcta ccccttggag ggcattctgg acttatctac
9601 caaaatttca aatgcacata ccctctgacc cagcagttcc acttaagtat ttggtcctga
9661 aatcttggta aaagtgccca aagatacaga acaaggatgt tcactatagc atctcttaga
9721 atatggcccc aaacaggaag caaccccaac ctctatcatg agggaggtca taaaattcct
9781 gcacatgcaa cagtgccatc ctctgcagcc tgtcaaagag gcaggcagca ctaactgctg FIG. 28A (continued)

9841 gactggaatg ttctccaaga tataataaat gcatttgttt gaaagcagct tgcagcacag
9901 tgcgtcaggc ctctgagccc aagccaagcc atcgcatccc ctgtgacttg cacgtatatg
9961 cctagatggc ctgaagtaac tgaagaatca caaaagaagt gaatatgccc tgccccgcct
10021 taactgatga cattccacca caaaagaagt gaaaaaggcc ggtccttgac ttaactgatg
10081 acattatctt atgaaattcc ttctcctggc tcatcctggc tcaaaaagct cccccactga
10141 gcacgttgcc acccccactc ctgcccgcca gagaacaaac cccctttttc ctttacctac
10201 ccaaatctta taaaacggcc tcacgcctat ctcccttcac tgactccctt ttcggactca
10261 gcccacctgc gcccaggtga aataaacagc cttgttgctc acacaaagcc tgtttggtgg
10321 tctcttcaca tggacgtgca ttaaatttgg tgccgtaact ggcgcggggg gaggggggggg
10381 ggaacctccc ttgggagatc aatcccctgt cctcctgctc tttggtccat gagaaagatc
10441 cacctacaac ctcaagtcct cagaccaacc agcccaagaa acatctcacc aatttcaaat
10501 ccagtaagca gcctcttttt actctcttct ccaacctccc tcactatccc tcaacctctt
10561 tctcctttca atcttggcgc cacacttcaa tttctccctt ctcttaactt caattccttt
10621 cattttctgg tagagataaa ggagacacgt tttatccgtg gacccaaaac tccagcgccg
10681 gtcacggact gggaaggcag ccttcccttg gtgtttaatc attgcaggga cacctctctg
10741 attattcacc caggtttcag aggtgtcaga ccacgcaggg acgcctgcct tggtccttca
10801 cccttagcgg caagtcccgc ttttctgggg aatgggcaag gaccccaacc ccttctctcc
10861 gtgtctctac cccttctccg cctttctggg gggcaagaaa cccccaaccc cttctccttc
10921 accctgagcg gcaagtcccg cttttctaga ggaggagcaa gtactccaac ctcatatctc
10981 tgcgccccaa tcccttattt ctgtgcccca acctcttatc tctgtgcccc aatcccttat
11041 ttccatgccc ccacctctta tatctctgca ccttgatccc ttatttccac atcccgacct
11101 cgtatctctg caccccgacc cctttcccac ttttctggag agtaagaacc cctgaaccgc
11161 ttctctccgt gtctctactc tcccttttct ttaaacttgc ctccttcact gtaggcaacc
11221 ttccactctc cattcctcct tcttctccct tagcctatgt tctcaaaaac ttaaaacctc
11281 ttcaactcac acctgaccta aaacctaaat gccttatttt cttctgcaat gccgcttgac
11341 cccaatacaa actcaacagt agttccaaat agccggaaaa cagcactttc aatttttcca
11401 tcctgcaaga tctaaataat tcttgtcgta aaatgggcaa atggtctgag gtgcctgacg
11461 tccaggcgtt cttttacaca tcagtccctc cctagtctct gttcccagtg caactcatcc
11521 caaatcttcc ttctttccct cccgcctgtc tcctcagtcc caaccccaag catcgctgag
11581 tctttctaat cttttctata gacccatctg acctctcccc tcctccccag gctgctcctt
11641 gccaggccga gctaggtccc aattcttcct cagcctccgc tcctccacca tataatcttt
11701 ttatcacctc ccctcctcac acccggtccg gcttacagtt tccttccgtg actagccctc
11761 ccctacctgc ccagcaattt tctcttaaaa aggtggctgg agctaaaggc atagtcaagg
11821 ttaatgctcc tttttcttta tcccaaatca gatagcgttt aggctctttt tcatcaaata
11881 taaaaaccca gcccagttca tgcctcgttt ggcagcaacc ctgagacact ttacggccct
11941 agaccctaaa agcccaaaag gccgtcttat tctcaatata tattttatca cccaatctgc
12001 tccctacatt aaataaaact ccaaaaatta aattccggcc ctcaaacccc acaacaggat
12061 ttaattaacc ttgccttcaa ggtgtacaat aatagaaaaa agttgcaatt ccttgcctcc
12121 actgtgagac aaaccccagc cacatctcca gcacacaaga acttccaaac acctgaactg
12181 cagcggccag gcattcctcc agaacctcct cccccaggag cttgctacaa gtgccagaaa
12241 tctggccacc aggccaagga atgcctgcag cccaggattc ctcctaagcc gtgtcccatc FIG. 28A (continued)

12301 tgtgcgggac cccactggaa atcggactgt ccaactcacc tggcagccac tcccagagcc
12361 cctggaactc cggcccaagg ctctctgact gactccttcc cagatcttct tggcttagcg
12421 gctgaagact gacactgccc gatcacctcg gaagccccct agaccatcac ggacgccgag
12481 ctgccagtaa ctctcacagt ggaaggtaaa cccgtcccct tcttaatcaa tacggaggct
12541 acccactcca cattaccttc ttttcaaggg cctgtttccc ttacctccat aactgttgtg
12601 cgtattgaca gccaggcttc taaacctctt aaaactcccc aactctggtg ccaacttaga
12661 caatactctt ttaagcactc cttttagtta tccccagctg cccagttccc ttattaggct
12721 gagacacttt aactaaatta tctgcttccc tgactattcc tgggctacag ccacacctca
12781 ttactgccct tcttcccaat ccaaagcctc ctttgtgtcc tcctcttgta tcccccgacc
12841 ttaacccata agtataagat acctctactc cctccttggt gaccgatcat gcaccccta
12901 ccatctcatc gaaacctaat caccccttacc ccgctcaaca ccaatatccc atcccacagc
12961 atgctttgaa aagactaaag cctgttatca ctctcctgct acagcatggc cttttaaagc
13021 ctataaactc tccttacaat tccccccattt cacttgtcct aaaaccagac aagccttaca
13081 agttagttca ggatctgtgc cttatcaacc acattgtttt gcctatccac cccatggtgt
13141 caaacccata tactctccta tcctcaatac ctcactccat aatccattat tgtgttctgg
13201 atctcaaaca tgctttcttt actattcctt tgcacccttc atcccagcct ctcttcactt
13261 tcacttggac tgaccctgac acccatcagg ctcagcaaat tacctgggct gtactgcccc
13321 aaagcttcac agacagcccc cattacatca gtcaagccca aattttttcc ctatctgtta
13381 cctatctcag cataattctc ataaagacac acgtgctctc cctgccgatc atgtccgatt
13441 aatctcccaa accccaaccc cttctacaaa acaagaactc ctttccttcc taggcatggt
13501 tagtgcagtc agaattctta cacaagagcc aggaccgcac cctgtagacc ttctgtccaa
13561 acaacttgac cttactgttt tagcctagcc ctcatgtctc tgtgcagcgg ctgctgccac
13621 cctaatactt ttagaggccc tcaaaatcac aaactatgct caactcactc tctacagtta
13681 tcataacttc caaaatctat tttcttcctc atacctgaca tatatacttt ctgctccccg
13741 gctccttcag ctgtactcac tctttattga gtctcccaca attaccattt ttcctggcac
13801 cgacttcaat ccagcctccc acattattcc tgataccaca cctgaccccc atgactgcat
13861 ctctctgatc cacctgacgt tcaccccatt tccccacatt tccttcttcc ctgcttctca
13921 ccctgatcac acttggttta tggatggcag ttccaccagg cctaatggcc acacaccagc
13981 aaaggcaggc tgtgctatag tacaagccgc tagcccgcct cttagaacct ctcatttcct
14041 ttccatcgtg gaaatctatc ctcaaggaaa taacttctca gtgttccatc tgctattcta
14101 ctgctcctca gggattattc aggccccctc ccttccctac acatcaagct cagggatttg
14161 cctccaccca ggactggcaa attgacttta ctcaacatgc cccgagtcag ataactaaaa
14221 tacctcttat tctaggtaga cactttcact ggataggtag aggcctttcc tacagggtct
14281 gagaaggcca ccatggtcat ttcttccctt ctgtcaaaca taattcctcg gtttggcctt
14341 cccacctcta tactgtctga taacagacca gcctttatta gtcaaatcag ccaagcgttt
14401 tttcaggctc ttagtattca gtgaaacctt tatatccctt acagtcctca gccttcagga
14461 aaggtagaac ggactaatga tcttttaaaa acacacctca ccaagctcag ccaccaactt
14521 aaaaaagact ggacaatact tttaccactt tcccttctca gaattcaggc ctgtccttgg
14581 aatgctacaa ggtacagccc atttgagctc ctgtatagac gctccttttt attaggcccc
14641 agtctcattc cagacaccag accaacttgg actgtgcccc aaaaaacttg tcatccctac FIG. 28A (continued)

14701 tatcttctgt ctagtcgtac tcctattcac cattctcaac tactcatacg tgccctgctc
14761 ttgtttacac tgccagttta cactgtttct ccaagccatc acagctgata tctcctggtg
14821 ctatccccaa accgccactc tgaactctta aatacataat ctttgctggc aggactatgc
14881 tgaacctcct ttggcactct ctaatcagat gtcctgagtc atctcaattc ttagaccttt
14941 tatacctgtt tttctccttt acttattccg tttagttttt caattcatac aaaaccgtat
15001 ccaggtcatc accaataatt ctaaatgacg aatgtttctt ctaacaaccg cacaatatca
15061 ccccttacca caagacctcc cttcagctta atctctccca ctctaggttc ccacgccgcc
15121 ccgaatcccg ctcgaagcag ccctgagaaa catcgcccat tctctctctc cacaccgccc
15181 cccaaaaatt ttcgctgccc caacacttcg acactatttt gttttatttt tcttattaat
15241 ataagaaggc aggaatgtca ggcctctgag cccaagctaa gccatcgcat cccctgtgac
15301 ctgcacgcat atataagccc agatggcctg aagtaactga agaatcacaa aagaagtgaa
15361 tatgccctgc cccaccttaa ctgatgacat tccaccacaa aagaagtgta aatggctggt
15421 tcttgcctta agtgatgaca ttaccttgtg aaagtccttt tcctggctca tcctggctca
15481 aaaagcaccc ccactgagca ccttgccgcc ccccactcctg cccgccagag aacaaacccc
15541 ctttgactgt aattttcctt tacctaccca aatcctataa aacggcccca cccccatctc
15601 cctgcactga ctctcttttc ggactcagcc cgcctgcacc caggtgaaat aaacagcttt
15661 attgctcaca caaa

FIG. 28A (continued)

*atg*gatgtctctctttgcccagccaagtgtagtttctggcggattttcttgctgggaagcgtctggctggactatgtgggctcc
gtgctggcttgccctgcaaattgtgtctgcagcaagactgagatcaattgccggcggccggacgatgggaacctcttccc
cctcctggaagggcaggattcagggaacagcaatgggaacgccagtatcaacatcacggacatctcaaggaatatca
cttccatacacatagagaactggcgcagtcttcacacgctcaacgccgtggacatggagctctacaccggacttcaaaa
gctgaccatcaagaactcaggacttcggagcattcagcccagagcctttgccaagaacccccatttgcgttatatctacct
cctgccccatctccttccatctaaacctggcctggacacccacggtatgcggcaccccacagccaacaccattcagag
ggtatttaagatgagcttcgttcccgttggcttctggcaaaggtttatagcacggatgctgatcagcctggcggagatggac
ctgcagctttttgaaaacaagaagaatactaaaagcaggaacaggaaagtcaccatttacagttttacaggaaaccag
agaaatcgctgtagcacattcagagtgaaaagaaatcagaccatctattggcaggaagggctcctggtcacttttgatgg
gggctacctcagtgtggaatcttccgacgtgaactggaaaaagaagaaaagcggaggaatgaaaattgtttgccaatc
agaagtgagggacttctcagccatggctttcatcacggaccacgtcaattccttgattgatcagtggtttcccgccctgaca
gccacagagagcgacgggacgccactcatggagcagtacgtgccctgcccggtctgcgagacagcctgggcccag
cacacggaccccagtgagaaatcagaggatgtgcagtacttcgacatggaagactgtgtcctgacggccatcgagcg
ggacttcatctcctgccccagacacccggacctccccgtgccgctgcaggagctggtccctgaactgttcatgaccgact
tcccggccaggctcttcctggagaacagcaagctggagcacagcgaggacgagggcagcgtcctgggccagggcg
gcagtggcaccgtcatctaccgggcccggtaccagggccagcctgtggccgtcaagcgcttccacatcaaaaaattca
agaactttgctaacgtaccggcagacaccatgctgaggcacctgcgggccaccgatgccatgaagaacttctccgagt
tccggcaggaggccagcatgctgcacgcgctgcagcaccccctgcatcgtggcgctcatcggcatcagcatccacccg
ctctgcttcgccctggagctcgcgccgctcagcagcctcaacaccgtgctgtccgagaacgccagagattcttcctttata
cccctgggacacatgctcacccaaaaaatagcctaccagatcgcctcgggcctggcctacctgcacaagaaaaacat
catcttctgtgacctgaagtcggacaacattctggtgtggtcccttgacgtcaaggagcacatcaacatcaagctatctga
ctacgggatttcgaggcagtcattccatgagggcgccctaggcgtggagggcactcctggctaccaggccccagagat
caggcctcgcattgtatatgatgagaaggtagatatgttctcctatggaatggtgctctacgagttgctgtcaggacagcgc

FIG. 28B cctgcactgggccaccaccagctccagattgccaagaagctgtccaagggcatccgcccggttctggggcagccgga
ggaagtgcagttccggcgactgcaggcgctcatgatggagtgctgggacactaagccagagaagcgaccgctggcc
ctgtcggtggtgagccagatgaaggacccgacttttgccaccttcatgtatgaactgtgctgtgggaagcagacagccttc
ttctcatcccagggccaggagtacaccgtggtgttttgggatggaaaagaggagtccaggaactacacggtggtgaac
acagagaagggcctcatggaggtgcagaggatgtgctgccctgggatgaaggtgagctgccagctccaggtccaga
gatccctgtggacagccaccgaggaccagaaaatctacatctacaccctcaagggcatgtgccccttaaacacaccc
caacaggccttggatactccagctgtcgtcacctgcttcttggccgtgcctgttattaaaaagaattcctacctggtcttagc
gggcctcgccgatgggcttgtggctgtgtttcccgtggtgcggggcaccccaaaggacagctgctcctacctgtgctcac
acacagccaacaggtccaagttcagcatcgcggatgaagacgcacggcagaaccccctacccagtgaaggccatgg
aggtggtcaacagcggctctgaggtctggtacagcaatgggccgggcctccttgtcatcgactgtgcctccctggagatc
tgcaggcggctggagccctacatggccccctccatggttacgtcagtcgtgtgcagctctgagggcagaggggaggag
gtcgtctggtgcctggatgacaaggccaactccttggtgatgtaccactccaccacctaccagctgtgtgcccggtacttct
gcggggtccccagccccctcagggacatgtttcccgtgcggcccttggacacggaacccccggcagccagccacac
ggccaacccaaaggtgcctgaggggactccatcgcggacgtgagcatcatgtacagtgaggagctgggcacgcag
atcctgatccaccaggaatcactcactgactactgctccatgtcctcctactcctcatccccaccccgccaggctgccagg
tccccctcaagcctccccagctccccagcaagttcttccagtgtgcctttctccaccgactgcgaggactcagacatgcta
catacgcccggtgctgcctccgacaggtctgagcatgacctgacccccatggacggggagaccttcagccagcacct
gcaggccgtgaagatcctcgccgtcagagacctcatttgggtccccaggcgcggtggagatgttatcgtcattggcctgg
agaaggattctggcgcccagcggggccgagtcattgccgtcttaaaagcccgagagctgactccgcatggggtgctgg
tggatgctgccgtggtggcaaaggacactgttgtgtgcacctttgaaaatgaaaacacagagtggtgcctggccgtctgg
aggggctggggcgccagggagttcgacattttctaccagtcctacgaggagctgggccggctggaggcttgcactcgc
aagagaaggtaa FIG. 28B (continued)

MDVSLCPAKCSFWRIFLLGSVWLDYVGSVLACPANCVCSKTEINCRRPDDGNLFPLL
EGQDSGNSNGNASINITDISRNITSIHIENWRSLHTLNAVDMELYTGLQKLTIKNSGLRS
IQPRAFAKNPHLRYIYLLPHLLPSKPGLDTHGMRHPTANTIQRVFKMSFVPVGFWQRF
IARMLISLAEMDLQLFENKKNTKSRNRKVTIYSFTGNQRNRCSTFRVKRNQTIYWQE
GLLVTFDGGYLSVESSDVNWKKKKSGGMKIVCQSEVRDFSAMAFITDHVNSLIDQWF
PALTATESDGTPLMEQYVPCPVCETAWAQHTDPSEKSEDVQYFDMEDCVLTAIERDFI
SCPRHPDLPVPLQELVPELFMTDFPARLFLENSKLEHSEDEGSVLGQGGSGTVIYRA
RYQGQPVAVKRFHIKKFKNFANVPADTMLRHLRATDAMKNFSEFRQEASMLHALQHP
CIVALIGISIHPLCFALELAPLSSLNTVLSENARDSSFIPLGHMLTQKIAYQIASGLAYLHK
KNIIFCDLKSDNILVWSLDVKEHINIKLSDYGISRQSFHEGALGVEGTPGYQAPEIRPRI
VYDEKVDMFSYGMVLYELLSGQRPALGHHQLQIAKKLSKGIRPVLGQPEEVQFRRLQ
ALMMECWDTKPEKRPLALSVVSQMKDPTFATFMYELCCGKQTAFFSSQGQEYTVVF
WDGKEESRNYTVVNTEKGLMEVQRMCCPGMKVSCQLQVQRSLWTATEDQKIYIYTL
KGMCPLNTPQQALDTPAVVTCFLAVPVIKKNSYLVLAGLADGLVAVFPVVRGTPKDSC
SYLCSHTANRSKFSIADEDARQNPYPVKAMEVVNSGSEVWYSNGPGLLVIDCASLEI
CRRLEPYMAPSMVTSVVCSSEGRGEEVVWCLDDKANSLVMYHSTTYQLCARYFCG
VPSPLRDMFPVRPLDTEPPAASHTANPKVPEGDSIADVSIMYSEELGTQILIHQESLTD
YCSMSSYSSSPPRQAARSPSSLPSSPASSSSVPFSTDCEDSDMLHTPGAASDRSEH
DLTPMDGETFSQHLQAVKILAVRDLIVVPRRGGDVIVIGLEKDSGAQRGRVIAVLKAR
ELTPHGVLVDAAVVAKDTVVCTFENENTEWCLAVWRGWGAREFDIFYQSYEELGRL
EACTRKRR

FIG. 28C

1 gcgcgcgcgc ctgctcgcct gcagccgggg agtcgcgcgg ggcggggccg cgtgcgcggg
61 gtcgggggcg cgcgaccgaa gcggataagg gacgcggcgg cggttggctg tgtctgttga
121 gagagtacag gacagcccgg actgcgagag gcggcggcgg aggcagtagt tgcaccggca
181 gaggcggccg ctggcagcgg ttgaggcggc ggtccaacgc gtgctctctg ggcggggtgc
241 ggcgggggat gtgcctgctc aggccgggcg gagtctctct gacagggcgg gggatgcgcc
301 gcggccgctc gcccggaccc tgaggctgct gggcccaccc tcccggaacc gtccgaccct
361 cggtggcctc ggcctcttct gccatctccg gtcctaccct ggggcggagg gtggaaggca
421 gcttccgtcg aagaggaggg ggctgcggtg gccaccgcgg cggagcccga gttattttac
481 caagaaaatg gtttgcacga ctttgaacat atactatcca tgctgatggg acaggatcca
541 at*atg*aatat aaatgatgga ggaagacgac gctttgaaga taatgaacat acattacgga
601 tatatcctgg ggctatttca gaagggacaa tctactgtcc gattcctgcc agaaaaaact
661 ccacagctgc tgaggtgatt gagtctctta taaacaaact tcatcttgac aaaacaaaat
721 gttatgttct agcagaggta aaggaatttg gtggagaaga atggattctc aatccaacag
781 attgtccagt tcagcgaatg atgctgtggc cccgaatggc tctggaaaat cgcttaagtg
841 gagaggacta ccgcttcctt ctgagagaga aaaaccttga tggatcaatc cattatggta
901 gcctgcagtc atggctacgg gtaacagaag aacgtcgcag gatgatggaa cggggttttc
961 ttccacagcc tcaacagaaa gactttgatg atttatgtag tttacctgat ttgaatgaga
1021 aaactctctt agaaaaccta cgaaatcgct ttaagcatga aaaaatttat acctatgttg
1081 gcagtattct aatagttatt aacccattca agtttcttcc tatttataac ccccaaatatg
1141 tcaaaatgta tgataaccac caactgggaa aacttgagcc ccacatttat gctgtggctg
1201 atgtagctta tcatgccatg cttcagcgca aaaagaatca gtgcatcgtg atttcaggag
1261 agagtggttc tgggaagact caaagcacaa actttcttat tcaccacctt actgctctca
1321 gtcagaaagg atttgccagt ggagtagaac agattattct tggagctgga ccagtacttg
1381 aggcctttgg aaatgcaaag acagctcata ataacaattc aagtcgtttt gggaagttta
1441 ttcaagtaaa ttaccaggaa acaggcactg tacttggtgc ctatgttgaa aaatatctac
1501 tggagaagtc cagactcgtt tatcaggagc ataatgaacg gaactatcat gtattctatt
1561 acctcctggc aggagcaagt gaagatgaga gatcagcatt ccatcttaag caaccagagg
1621 aatatcatta tctcaatcag ataacaaaga aacccctcag acagagctgg gatgattatt
1681 gctatgactc tgagccggat tgcttcacgg tggaaggaga agatttgaga catgactttg
1741 agcgcctaca acttgccatg gaaatggtag gatttcttcc caagacacga agacagattt
1801 tctctcttct ctcagccata ctacatttgg gtaatatctg ttacaaaaag aagacatacc
1861 gggatgactc cattgatatc tgtaatcctg aagttctgcc tattgtctca gaattattag
1921 aggttaaaga agagatgcta tttgaagcat tagttacaag gaagacggtg acagtgggag
1981 aaaagcttat tttgccatac aagttggcag aggctgtgac agtgaggaac tccatggcta
2041 agtctctgta tagtgccctg tttgactgga tagtttttcg aattaatcat gcacttctga
2101 atagtaaaga tttagagcat aataccaaga cattgtctat tggtgttctt gatatttttg
2161 ggtttgaaga ttatgaaaat aacagctttg aacagttctg tattaatttt gctaatgaac
2221 gtttacagca ctactttaat cagcatatct ttaaattgga acaagaggaa tatagaactg
2281 aaggtatcag ctggcacaac atagattaca ttgataatac ctgctgcata aatcttatta
2341 gcaaaaaacc aacaggactg cttcatcttt tggatgaaga aagcaacttt ccacaggcta
2401 caaatcaaac attgctagac aagtttaagc atcaacatga agataattct tacatcgaat
2461 ttccagccgt gatggagcct gctttcatta taaaacatta tgctggaaaa gtaaaatatg

FIG. 29

2521 gggtaaagga tttccgggaa aaaaatacag atcatatgcg cccagacatt gtagctcttc
2581 tgagaagcag caagaatgca tttatctctg ggatgattgg aattgatcct gtagctgttt
2641 tccgatgggc aattctccga gcttttttca gagccatggt tgctttcagg gaagctggga
2701 aaagaaacat tcacagaaaa actggacatg atgatacagc gccatgtgca attttgaaaa
2761 gtatggatag ttttagcttt ctccaacacc cagtccacca gaggagctta gagattctgc
2821 agagatgcaa ggaagagaag tacagtataa cccggaaaaa tcccagaaca cctctttctg
2881 atctccaggg catgaatgct ctaaatgaaa aaaaccaaca tgatacattt gatattgcct
2941 ggaatggcag aactgggatt cgccagagca gactatcaag tggcacctcc ttgcttgata
3001 aagatggaat atttgctaat tcaactagca gcaaactcct ggagagagcc catggaattc
3061 tcacgagaaa caaaaatttc aaatccaagc ctgcccttcc aaagcacttg ctagaagtaa
3121 attctttaaa gcacctgaca agactgacac tacaagatcg cattaccaag tctcttcttc
3181 atttacacaa gaagaaaaaa cctcccagca tcagtgccca gtttcaggca tcattaagca
3241 agctaatgga aacacttggt caagcagaac catattttgt aaaatgcatt cgctctaatg
3301 ctgaaaagct gcccttaagg ttcagtgatg tcttggtact tagacagctt cgatacaccg
3361 ggatgctgga aacagttcga attcgccaat caggatacag ctccaaatat tctttccagg
3421 attttgtgag ccacttccat gtacttcttc cccgaaatat tattccatcc aaatttaaca
3481 ttcaggattt cttcaggaaa ataaatctta atccagataa ttatcaagtt ggaaaaacca
3541 tggtctttct aaaggagcag gaacgacagc acttacaaga tctgcttcac caagaggtgc
3601 tccgcagaat catattgttg cagcgatggt tcagggtctt gctgtgtagg cagcatttcc
3661 tccatctgag acaagcatct gttattatcc agagattctg gaggaattac ctaaatcaga
3721 agcaagtcag agatgcagct gtgcagaagg atgcttttgt tatggctagt gcagctgctc
3781 ttctccaagc ttcctggcgt gctcacttag agaggcagcg gtacttggag ttacgggctg
3841 cagccatcgt tatccagcag aaatggagag attactatag gcgcaggcac atggctgcta
3901 tttgcataca agcaagatgg aaagcctaca gggaaagtaa aaggtaccaa gaacaaagga
3961 aaaaaattat ccttttgcaa tcaacatgta gaggattcag agcaagacaa agatttaaag
4021 ctttaaaaga acaaaggcta agagaaacaa agccagaagt tggattggtg aatattaagg
4081 gatatggatc tctggaaatt cagggttcag acccttcagg atgggaggat tgttcttttg
4141 acaacagaat aaaagccata gaggaatgta aatctgtaat agagagtaat cgaattagcc
4201 gtgaaagttc agtggactgc ttgaaggagt caccaaacaa gcagcaggag agagcccaaa
4261 gccagagtgg tgtggacttg caggaagatg tgcttgtaag agagagaccc agatccttgg
4321 aggatctcca tcagaaaaaa gtaggccggg ctaagagaga aagtaggaga atgagagaac
4381 tagagcaagc tatatttagc ttagaattgc tgaaagttcg ttctcttggt ggtatttctc
4441 cttcagagga tcgcagatgg tctacagaat tggtgcctga aggccttcag tctccacggg
4501 gtacacctga tagtgagagc tctcaaggaa gcttggaact tctgagctat gaggaaagcc
4561 aaaagagcaa actagagtct gtcatttcag atgaaggaga cttgcagttt ccatcaccta
4621 agatatccag cagtccaaaa tttgattcac gggacaatgc cctcagtgcc tcaaatgaga
4681 ctagcagtgc agagcatttg aaggatggaa ctatgaagga aatggtggtc tgcagttctg
4741 agtctattac ctgtaaacca cagctgaaag actccttcat ttcaaatagt ctacctactt
4801 ttttttatat cccccaacaa gacccactga aaacaaattc ccaactagac acaagtatcc
4861 aaagaaacaa actattggaa aatgaagaca cagcggggga agctcttact ttggatatca
4921 acagggaaac tagaaggtat cactgctcag gaaaagatca gattgttcct tctttgaata FIG. 29 (continued)

4981 cagagtcttc taatcctgtg cttaagaagt tagaaaagct aaacactgag aaggaagaaa
5041 ggcaaaaaca gttgcagcaa cagaatgaaa aagagatgat ggaacagatt cgccagcaaa
5101 cagatatttt agagaaggag cgcaaagcct tcaagacaat tgaaaagcca agaattggag
5161 agtgtttggt ggcaccatct tcctatcagt caaagcaaag agtagagagg ccatcctctc
5221 tcctcagctt aaatacctca aataagggag aacttaatgt actggggtcc ctatcattaa
5281 aagatgcagc tcttgcccaa aaagacagtt cctctgctca cttacccca aaggaccgac
5341 ctgtcaccgt gttctttgaa agaaaaggaa gtccatgcca atctagtact gtcaaggaat
5401 tatccaagac agacagaatg ggcacccagc tgaatgtagc ctgtaaactc tcaaataatc
5461 gcatttcaaa aagagaacac tttaggccaa ctcagtctta cagccacaat tctgatgacc
5521 tttccagaga gggaaatgct aggcccattt tcttcactcc aaaggacaat atgagtattc
5581 cccttgtcag caaagaagcc ttaaacagta aaaatcctca actccataaa gaagatgaac
5641 cagcatggaa acctgtgaag ttagctgggc caggccaaag agagacatca cagcgatttt
5701 cgtcagttga tgaacaagca aaacttcata agactatgtc tcaaggagag attaccaagt
5761 tggcagtgag acagaaggct tcagattcag atataagacc tcagagagct aagatgagat
5821 tctgggccaa agggaaacaa ggggagaaga agactaccag agtgaaacct actacccagt
5881 cagaggtttc gccactcttt gcaggcacag atgtgattcc agctcatcag tttccagatg
5941 aattagctgc atatcaccca acacctcctt tgagcccaga actgcccggc agttgccgga
6001 aggaattcaa agagaacaaa gaaccttctc caaaggctaa gcgcaagcga agtgtgaaga
6061 ttagcaacgt ggctttggat tctatgcatt ggcaaaatga ctctgtccag atcatagcaa
6121 gtgtcagtga tttaaaaagc atggatgaat ttcttctgaa aaaggtgaat gacctagata
6181 atgaagacag caagaaggat acactagtgg atgttgtatt taaaaaagcc ctgaaggaat
6241 ttcggcagaa tatcttcagc ttttattcat ctgcattggc gatggatgat gggaaaagca
6301 tacggtataa agacctctat gcactatttg aacagattct ggaaaagacg atgaggcttg
6361 agcagcgtga ttcactgggt gaatctccag tgagagtttg ggtcaacact tttaaagtgt
6421 ttttagatga atatatgaat gaattcaaga cttcagattg cacagccaca aaggtgccaa
6481 aaacagaaag aaagaaaaga aggaaaaagg aaactgattt ggtggaagaa cacaatggtc
6541 acatctttaa agccacccaa tatagcatcc ctacatactg tgaatactgt tcttctttga
6601 tatggataat ggaccgagcc tctgtttgca aattatgcaa gtatgcttgc cataagaagt
6661 gctgtctgaa aaccacagcc aagtgctcta aaaagtatga tccagagctg tcatctcgac
6721 aatttggggt tgaactgtcc cgtttgacca gtgaagaccg aactgttcct ttagtagtgg
6781 aaaagctcat aaactacatt gaaatgcatg gactgtatac agaaggtatt tatcgaaagt
6841 ctggttcgac taataaaatc aaggagcttc ggcagggtct agatacagagat gctgagagtg
6901 taaatctaga tgactataac atacacgtca ttgcaagtgt attcaaacaa tggcttcgag
6961 atttgcccaa tcctctcatg acctttgaac tctatgagga atttcttcga gctatgggcc
7021 ttcaggagag gaaggagaca atccgtggtg tatactctgt gattgatcaa ctctcccgaa
7081 ctcatctcaa tacactggaa cgcctcatct ttcatctagt caggattgct ctgcaggaag
7141 acactaatcg aatgtctgct aatgctttgg ccattgtgtt tgcgccctgc attctccgct
7201 gccctgacac cactgaccca ctacaaagtg tacaggacat cagtaagact accacttgtg
7261 tggaactgat tgttgtggaa caaatgaata aatacaaggc tcgtctcaaa gatatcagta
7321 gcttggaatt tgctgagaat aaggcaaaga ccaggttgtc actgattcgt agatcaatgg
7381 gaaaggggcg tattcgtcga ggaaactatc caggtccatc gtctcctgtt gtagttcggt FIG. 29 (continued)

7441 tgccttctgt gtctgatgtc tcagaggaga ccttgactag tgaggcagcc atggagactg
7501 acatcacaga acagcagcaa gcagctatgc agcaggagga gagagtactg actgagcaga
7561 ttgagaacct acagaaggag aaggaggagc taacatttga gatgcttgta ctggaacccc
7621 gtgcctctga tgatgaaacc cttgagtctg aggcctccat tgggactgct gatagctcag
7681 agaatttgaa tatggagtct gaatatgcta tctctgagaa atcagaaaga agcttagccc
7741 ttagctccct gaagacagct ggcaagtctg aaccttccag caagttgcga aagcaactta
7801 aaaagcagca agactcttta gatgtcgtgg actcttcggt ctcctcttta tgtctgtcta
7861 acacggcatc atctcatggg accagaaaac tatttcagat ttattccaaa tctccattct
7921 accgagctgc ctcaggtaat gaggccctgg gaatggaagg accattgggc cagaccaaat
7981 tcctggaaga caagcctcag ttcatcagca gaggaacctt caacccggaa aagggcaaac
8041 aaaaattaaa gaatgtgaaa aactcacctc agaaaaccaa agagacccca gaggggacag
8101 tcatgtctgg ccgcagaaaa actgtggacc cagactgcac ctccaaccaa cagctagcac
8161 tctttggaaa taatgaattt atggtc*tga*a ccggcagatg tgtgtccctc cgtggctaca
8221 gagtggtaaa caaatctcac ctttggggct gcgtttcatc acctcgtcca caatagtcaa
8281 tcctaattgt ggtcctgcct cttttctaag catatggcta agactgtatg tgctgaattc
8341 ctgggcctcc tgcagaagca gaaagcctgc tggggatggt gccagctgtg ccttggctgt
8401 tgtatttgaa ttgagatttt tactatacaa agccacctag ggcctgggga tttgggtcag
8461 ttgtagttgc ctctccccca ccctcttttc ccttcccaaa ggtgggtgtt gaactagggg
8521 ggatattgct gtcctgaggg accctctcat ttctgacatt tgaagaaaac gtataaatct
8581 ttcttaaccg tgaaagcaaa agcctttggg tttattttgg gatagttagg agctagggta
8641 gaatataatt tttttccaaa aacttactta caaacaaaaa gcctaatccc tctattttaa
8701 gatttctgaa aaaacactcc atgttatatt ctggggaaag caaaaacaaa aaaaaaaaac
8761 aaaaaaaaaa aaacaaaaaa aaaccgtgat tgtttccatt aagccatcag agcgtgtctc
8821 agatatcttg ttatacagtg aagaagagaa tacctatttt ttttgatgat gtttgatgtc
8881 atagtaatca gtgctggttt aactcctgtt tagttcctgc caaatacatt gcatgggctg
8941 aagtgtcagt agccatactg ttctcatgtt tcttggtcct aggatcagat tcttctacat
9001 tattttttag tttcccagag acatggtgat ccctaaactt atgaaggttt catcctaagc
9061 cattcaggct tttctctttg tatagattaa accgaaaacc gcatatgagc ctgttcatct
9121 gctggtggat tcccaccaca gactcagact caaacaaaca aacaaataat gtgaccgttt
9181 agttagtttc caaaaacatt cacatacaat attgcatgaa taagtaagta agtgttacag
9241 aaagctgcca aaaaataaaa aggtttttaa tatgacctat ctaactaact aacttttatc
9301 ttccttttct cagactatca gtattaaata gatggaaaaa aatcaaggac tacttgaagc
9361 tatttttgtt aatattctgg ttactgaagt ttattgtaaa tatgtatgta tagtaggcat
9421 atttcttttt aaccttgtgc ttccctcctt cccatggaat ttcttcccac agatgagggg
9481 ccactggaca gggggatgag agccattcgt ccctgggttg agggaattag taagacatca
9541 ttttcaccac tgggtggtct tcatacacat gagttataat agcattttaa gtatcttagc
9601 atttgtggga ttagaaatct gtttttgcta tttataatat ataaaaaatg aaacatgata
9661 gcctttcttg agataagtat gtgaaatgtt tatttttaaa gttactaaat gcatcttgtc
9721 ttgctactac atgcactgct ctgaaaaaga gcctttacca tctataacct gtattttggg
9781 tattcttcct tttcatactt ctttgaagtt gtggaaatat taagtctttt gttaaggcag
9841 agtctctctc tcctgttaca caacactgaa cctcacgcca ctgcctcagt ggttattggc FIG. 29 (continued)

9901 cagccccaga ggttagactt ggagcataat tctgagtggc agctaaaggt agcaggagtc
9961 ttacctctcc ctactttggg ttcagaattg agccagagaa aggaagccat taaaatctcc
10021 agaataatga tagttaatga gcaaatgtta tgctttatat cccacagaca tctgccacct
10081 tgttcatctt gtcctgagga gtaataaata atgttaagct tttaaaaatc tgaatttcag
10141 agaatctcct agaggataga ggaaaacccc tcagcatggt gtgttagagt gggattgctg
10201 gttcctcagc cccgtgccag gttgcacagt ctgtgtttca gtgttcttgg gagagtagtg
10261 tactgctggg cattaattgt tactctgcac ttgctccaga atgttggtta aatcctgtat
10321 gaaaaaaaga gattgccctt atggaataat ttcctgtggc ccagaggaat ggccagaaga
10381 acatatgttg gcacatgttc ttccttctaa atctttgtgg ggctttttttg gcaaaataag
10441 tttttggca gttaaaaaac gactgatgta ggtcacttta aaggaactag gtgatggatg
10501 ttaagagact ttataatttt tctcagggac ctgaaactcc agtttggata aaattcaatt
10561 aaaaaaactt gttttttcag ttgctagatt tgtggatttc tagtaattta atctgccagg
10621 attggggtgg gtgggtgagg aggagagagc cacaaaatga taagagtgga gagcagtgtg
10681 gggccctccc tttgagggaa agccgttgtt tacatagggt agtaggcctt gttggcctga
10741 tcaagagatg aagccataac tcttaaaaac cttcagaacc aaacgctgtg tctgcatcca
10801 tctgttctca ctggccctct gcatggtaaa gttatgtcac cacaaagtga tgccgcatta
10861 caatcactta tgaaactgtt agcccttaat atgcatcaca tttgtggttc catagtgctt
10921 ctcctttgct tgtttgatct ctgcatggca gcagtggggc agctccacat ttggagccca
10981 tactccaaaa tgcagagcac tcttctcaca gcacacattc ccagccccaa acaaaacctg
11041 aattttcaac tctgcccatt aaagtgaatg tatccctgta atttagtatg tacttattat
11101 ggaaaatgta acaaaagcag agaagtgtga tttcattctg tatcacaaat tgaagcaaat
11161 caacagcaaa tacagcagga ttcagggagg cttagtttac aacgtacttt gtacctcctg
11221 ccatttaaat tattttgcca ctctgggctt ctgaaaacac aaagggagat acagccctcc
11281 aactatgagc cttgcagaga gagacaaaag ggccagaggt cctgggatgg aatactagag
11341 cccccacctt ctcatgcttt ggaaacctgc cagagcactt accctgctgg aagattaatg
11401 aagactccat tctgtgtttc ataacagtag cgttgttttc tccatcaaaa acagagggtc
11461 acagaaatgt gctgaaaaga tgtggtccag caaggttctg tagtcccacc tcagtgcctg
11521 tgggctgtgt ttttcactgt aacaagcact ttggtaaact agaaagaaga aaggattctc
11581 aggatgtgtt caaagctaag agagttttca ttttaaaaag aaacatacat actcactcca
11641 tggctttcct catcctcctc tcttttttct tcttggtggg aagctggatg cggggcatgc
11701 atcattctgt atggacaaat gtgttatgtc cacccatact cttgtgacaa ctccccagca
11761 ctgtcctgca ataccatgct ggccttggta gtaaaactcc ttggtatctg tgagagtcct
11821 ctttttctat gccctagact acttttaacc acttttctct ggaatgactc ccacatttga
11881 ttgggtattg aaagggtaac agcaaaatga tgattgtgga gatggatcta ttaggtctca
11941 tgttggtccc ctggttgaaa ctattttcaa aaaagcccca acaatgggcc tgtcaccttg
12001 ctagtcatcc attcttaatg cctatttatc agccctctga ggtcatataa aagttgcacc
12061 ttttgaacca agtatttgta tttactatgg gaaaggtgtg gactacagat tcgtattata
12121 ttattttaat ggattttaag taatttataa gtatgctgag tgtaaatttt ttttaaaaac
12181 tgtattataa aaggacatat cctgtgaaat ataacatttt actgtttaat agaataattc
12241 tataagaaga atgatttatc tcacccacgg aactgattac attccggatg caatcaatag
12301 gcactttgta atttcctttt tgtttttttt tctttgctgg ggggttgagg ggtaacaaga
12361 taccatctgt ataaagtgca gtttgtgtca ctcaaaatat gcactgtatg gctacacaaa
12421 agcagcttga tgaacaaatc accccatggc tcattaaaga acaaagcttc cagaagca

FIG. 29 (continued)

1 __a__gttcccgtt ccgggcccgc gaggcagccg ccccggtcct gcccctccct cgcgctactg
61 cgggagcagc gtcctcccgg gccacggcgc ttcccggccc cggcgtcccc ggaccatggc
121 gctctccggg ctcttctcta gctctcagcg gctgcgaagt ctgtaaacct ggtggcca__ag__
181 tgattgtaag tcaggagact ttccttcggt ttctgccttt gatggcaaga ggtggagatt
241 gtggcggcga ttacagaaaa catctgggaa gacaagttgc tgtttttatg ggaatcgcag
301 gcttggaaga gacagaagc__a a__ttccagaaa taaattggaa attgaagatt taaacaatgt
361 tgttttaaaa tattctaact tcaaagaatg atgccagaaa cttaaaaa__gg__ ggctgcgcag
421 agtagcaggg gccctggagg gcgcggcctg aatcctgatt gcccttctgc tgagaggaca
481 cacgcagctg aagatgaatt tgggaaaagt agccgcttgc tactttaact *atg*gaagagc
541 agggccacag tgagatggaa ataatcccat cagagtctca cccccacatt caattactga
601 aaagcaatcg ggaacttctg gtcactcaca tccgcaatac tcagtgtctg gtggacaact
661 tgctgaagaa tgactacttc tcggccgaag atgcggagat tgtgtgtgcc tgccccaccc
721 agcctgacaa __gg__tccgcaaa attctggacc tggtacagag caagggcgag gaggtgtccg
781 agttcttcct ctacttgctc cagcaactcg cagatgccta cgtggacctc aggccttggc
841 tgctggagat cggcttctcc ccttccctgc tcactcagag caaagtcgtg gtcaacactg
901 accca__gt__gag caggtatacc cagcagctgc gacaccatct gggccgtgac tccaagttcg
961 tgctgtgcta tgcccagaag gaggagctgc tgctggagga gatctacatg gacaccatca
1021 tggagctggt tggcttcagc aatgagagcc tgggcagcct gaacagcctg gcctgcctcc
1081 tggaccacac caccggcatc ctcaatgagc agggtgagac catcttcatc ctgggtgatg
1141 ctggggtggg caagtccatg ctgctacagc ggctgcagag cctctgggcc acgggccggc
1201 tagacgcagg ggtcaaattc ttcttccact ttcgctgccg catgttcagc tgcttcaagg
1261 aaagtgacag gctgtgtctg caggacctgc tcttcaagca ctactgctac ccagagcggg
1321 accccgagga ggtgtttgcc ttcctgctgc gcttccccca cgtggccctc ttcaccttcg
1381 atggcctgga cgagctgcac tcggacttgg acctgagccg cgtgcctgac agctcctgcc
1441 cctgggagcc tgcccacccc ctggtcttgc tggccaacct gctcagtggg aagctgctca
1501 agggggctag caagctgctc acagcccgca caggcatcga ggtcccgcgc cagttcctgc
1561 ggaagaaggt gcttctccgg ggcttctccc ccagccacct gcgcgcctat gccaggagga
1621 tgttccccga gcgggccctg caggaccgcc tgctgagcca gctggaggcc aaccccaacc
1681 tctgcagcct gtgctctgtg cccctcttct gctggatcat cttccggtgc ttccagcact
1741 tccgtgctgc ctttgaaggc tcaccacagc tgcccgactg cacgatgacc ctgacagatg
1801 tcttcctcct ggtcactgag gtccatctga acaggatgca gcccagcagc ctggtgcagc
1861 ggaacacacg cagcccagtg gagaccctcc acgccggccg ggacactctg tgctcgctgg
1921 ggcaggtggc ccaccggggc atggagaaga gcctctttgt cttcacccag gaggaggtgc
1981 aggcctccgg gctgcaggag agagacatgc agctgggctt cctgcgggct ttgccggagc
2041 tgggccccgg gggtgaccag cagtcctatg agtttttcca cctcaccctc caggccttct
2101 ttacagcctt cttcctcgtg ctggacgaca gggtgggcac tcaggagctg ctcaggttct
2161 tccaggagtg gatgcccccct gcgggggcag cgaccacgtc ctgctatcct cccttcctcc
2221 cgttccagtg cctgcagggc agtggtccgg cgcgggaaga cctcttcaag aacaaggatc
2281 acttccagtt caccaacctc ttcctgtgcg ggctgttgtc caaagccaaa cagaaactcc
2341 tgcggcatct ggtgcccgcg gcagccctga ggagaaagcg caaggccctg tgggcacacc
2401 tgttttccag cctgcggggc tacctgaaga gcctgccccg cgttcaggtc gaaagcttca

FIG. 30A 2461 accaggtgca ggccatgccc acgttcatct ggatgctgcg ctgcatctac gagacacaga
2521 gccagaaggt ggggcagctg gcggccaggg gcatctgcgc caactacctc aagctgacct
2581 actgcaacgc ctgctcggcc gactgcagcg ccctctcctt cgtcctgcat cacttcccca
2641 agcggctggc cctagaccta gacaacaaca atctcaacga ctacggcgtg cgggagctgc
2701 agccctgctt cagccgcctc actgttctca __ga__ctcagcgt aaaccagatc actgacggtg
2761 gggtaaaggt gctaagcgaa gagctgacca aatacaaaat tgtgacctat ttgg__gt__ttat
2821 acaacaacca gatcaccgat gtcggagcca ggtacgtcac caaaatcctg gatgaatgca
2881 aaggcctcac gcatctta__aa__ ctgggaaaaa acaaaataac aagtgaagga gggaagtatc
2941 tcgccctggc tgtgaagaac agcaaatcaa tctctgaggt tg__gg__atgtgg ggcaatcaag
3001 ttggggatga aggagcaaaa gccttcgcag aggctctgcg gaaccacccc agcttgacca
3061 ccctga__gt__ct tgcgtccaac ggcatctcca cagaaggagg aaagagcctt gcgagggccc
3121 tgcagcagaa cacgtctcta gaaatactgt __gg__ctgaccca aaatgaactc aacgatgaag
3181 tggcagagag tttggcagaa atgttgaaag tcaaccagac gttaaagcat ttat__gg__ctta
3241 tccagaatca gatcacagct aaggggactg cccagctggc agatgcgtta cagagcaaca
3301 ctggcataac agagattt__gc__ ctaaatggaa acctgataaa accagaggag gccaaagtct
3361 atgaagatga gaagcggatt atctgtttc*__t ga__*gaggatgc tttcctgttc atggggtttt
3421 tgccctggag cctcagcagc aaatgccact ctgggcagtc ttttgtgtca gtgtcttaaa
3481 ggggcctgcg caggcgggac tatcaggagt ccactgcctc catgatgcaa gccagcttcc
3541 tgtgcagaag gtctggtcgg caaactccct aagtacccgc tacaattctg cagaaaaaga
3601 atgtgtcttg cgagctgttg tagttacagt aaatacactg tgaagagact ttattgccta
3661 ttataattat ttttatctga agctagagga ataaagctgt gagcaaacag aggaggccag
3721 cctcacctca ttccaacacc tgccataggg accaacggga gcgagttggt caccgctctt
3781 ttcattgaag agttgaggat gtggcacaaa gttggtgcca agcttcttga ataaaacgtg
3841 tttgatggat tagtattata cctgaaatat tttcttcctt ctcagcactt tcccatgtat
3901 tgatactggt cccacttcac agctggagac accggagtat gtgcagtgtg ggatttgact
3961 cctccaaggt tttgtggaaa gttaatgtca aggaaaggat gcaccacggg cttttaattt
4021 taatcctgga gtctcactgt ctgctggcaa agatagagaa tgccctcagc tcttagctgg
4081 tctaagaatg acgatgcctt caaaatgctg cttccactca gggcttctcc tctgctaggc
4141 taccctcctc tagaaggctg agtaccatgg gctacagtgt ctggccttgg gaagaagtga
4201 ttctgtccct ccaaagaaat agggcatggc ttgcccctgt ggccctggca tccaaatggc
4261 tgcttttgtc tcccttacct cgtgaagagg ggaagtctct tcctgcctcc caagcagctg
4321 aagggtgact aaacgggcgc caagactcag ggatcggct gggaactggg ccagcagagc
4381 atgttggaca ccccccacca tggtgggctt gtggtggctg ctccatgagg gtgggggtga
4441 tactactaga tcacttgtcc tcttgccagc tcatttgtta ataaaatact gaaaacactc
4501 tt__a__

FIG. 30A (continued)

*atg*gaagagcagggccacagtgagatggaaataatcccatcagagtctcacccccacattcaattactgaaaagcaa
tcgggaacttctggtcactcacatccgcaatactcagtgtctggtggacaacttgctgaagaatgactacttctcggccga
agatgcggagattgtgtgtgcctgccccacccagcctgacaaggtccgcaaaattctggacctggtacagagcaaggg
cgaggaggtgtccgagttcttcctctacttgctccagcaactcgcagatgcctacgtggacctcaggccttggctgctgga
gatcggcttctccccttccctgctcactcagagcaaagtcgtggtcaacactgacccagtgagcaggtatacccagcag
ctgcgacaccatctgggccgtgactccaagttcgtgctgtgctatgcccagaaggaggagctgctgctggaggagatct
acatggacaccatcatggagctggttggcttcagcaatgagagcctgggcagcctgaacagcctggcctgcctcctgg
accacaccaccggcatcctcaatgagcagggtgagaccatcttcatcctgggtgatgctggggtgggcaagtccatgct
gctacagcggctgcagagcctctgggccacgggccggctagacgcaggggtcaaattcttcttccactttcgctgccgc
atgttcagctgcttcaaggaaagtgacaggctgtgtctgcaggacctgctcttcaagcactactgctacccagagcggga
ccccgaggaggtgtttgccttcctgctgcgcttcccccacgtggccctcttcaccttcgatggcctggacgagctgcactcg
gacttggacctgagccgcgtgcctgacagctcctgcccctgggagcctgcccaccccctggtcttgctggccaacctgct
cagtgggaagctgctcaagggggctagcaagctgctcacagcccgcacaggcatcgaggtcccgcgccagttcctgc
ggaagaaggtgcttctccggggcttctcccccagccacctgcgcgcctatgccaggaggatgttccccgagcgggccc
tgcaggaccgcctgctgagccagctggaggccaaccccaacctctgcagcctgtgctctgtgcccctcttctgctggatc
atcttccggtgcttccagcacttccgtgctgcctttgaaggctcaccacagctgcccgactgcacgatgaccctgacagat
gtcttcctcctggtcactgaggtccatctgaacaggatgcagcccagcagcctggtgcagcggaacacacgcagccca
gtggagaccctccacgccggccgggacactctgtgctcgctggggcaggtggcccaccggggcatggagaagagcc
tctttgtcttcacccaggaggaggtgcaggcctccgggctgcaggagagagacatgcagctgggcttcctgcgggctttg
ccggagctgggccccgggggtgaccagcagtcctatgagtttttccacctcaccctccaggccttctttacagccttcttcct
cgtgctggacgacagggtgggcactcaggagctgctcaggttcttccaggagtggatgccccctgcgggggcagcga
ccacgtcctgctatcctcccttcctcccgttccagtgcctgcagggcagtggtccggcgcgggaagacctcttcaagaac
aaggatcacttccagttcaccaacctcttcctgtgcgggctgttgtccaaagccaaacagaaactcctgcggcatctggtg
cccgcggcagccctgaggagaaagcgcaaggccctgtgggcacacctgttttccagcctgcggggctacctgaagag
cctgccccgcgttcaggtcgaaagcttcaaccaggtgcaggccatgcccacgttcatctggatgctgcgctgcatctacg
agacacagagccagaaggtggggcagctggcggccaggggcatctgcgccaactacctcaagctgacctactgca
acgcctgctcggccgactgcagcgccctctccttcgtcctgcatcacttccccaagcggctggccctagacctagacaac
aacaatctcaacgactacggcgtgcgggagctgcagccctgcttcagccgcctcactgttctcagactcagcgtaaacc
agatcactgacggtggggtaaaggtgctaagcgaagagctgaccaaatacaaaattgtgacctatttgggtttatacaa
caaccagatcaccgatgtcggagccaggtacgtcaccaaaatcctggatgaatgcaaaggcctcacgcatcttaaact
gggaaaaaacaaaataacaagtgaaggagggaagtatctcgccctggctgtgaagaacagcaaatcaatctctgag
gttgggatcctggtgggcaatccatttacatgctcctgtgacattatgtggatcaagactctccaagaggctaaatccagtc
cagacactcaggatttgtactgcctgaatgaaagcagcaagaatattcccctggcaaacctgcagatacccaattgtggt
ttgccatctgcaaatctggccgcacctaacctcactgtggaggaaggaaagtctatcacattatcctgtagtgtggcaggt
gatccggttcctaatatgtattgggatgttggtaacctggtttccaaacatatgaatgaaacaagccacacacagggctcc
ttaaggataactaacatttcatccgatgacagtgggaagcagatctcttgtgtggcggaaaatcttgtaggagaagatca
agattctgtcaacctcactgtgcattttgcaccaactatcacatttctcgaatctccaacctcagaccaccactggtgcattc
cattcactgtgaaaggcaaccccaaaccagcgcttcagtggttctataacggggcaatattgaatgagtccaaatacatc
tgtactaaaatacatgttaccaatcacacggagtaccacggctgcctccagctggataatcccactcacatgaacaatg
gggactacactctaatagccaagaatgagtatgggaaggatgagaaacagatttctgctcacttcatgggctggcctgg

FIG. 30B aattgacgatggtgcaaacccaaattatcctgatgtaatttatgaagattatggaactgcagcgaatgacatcggggaca
ccacgaacagaagtaatgaaatcccttccacagacgtcactgataaaaccggtcgggaacatctctcggtctatgctgt
ggtggtgattgcgtctgtggtgggattttgccttttggtaatgctgtttctgcttaagttggcaagacactccaagtttggcatga
aagatttctcatggtttggatttgggaaagtaaaatcaagacaaggtgttggcccagcctccgttatcagcaatgatgatg
actctgccagcccactccatcacatctccaatgggagtaacactccatcttcttcggaaggtggcccagatgctgtcattat
tggaatgaccaagatccctgtcattgaaaatccccagtactttggcatcaccaacagtcagctcaagccagacacatttg
ttcagcacatcaagcgacataacattgttctgaaaagggagctaggcgaaggagcctttggaaaagtgttcctagctga
atgctataacctctgtcctgagcaggacaagatcttggtggcagtgaagaccctgaaggatgccagtgacaatgcacgc
aaggacttccaccgtgaggccgagctcctgaccaacctccagcatgagcacatcgtcaagttctatggcgtctgcgtgg
agggcgacccccctcatcatggtctttgagtacatgaagcatggggacctcaacaagttcctcagggcacacggccctg
atgccgtgctgatggctgagggcaacccgcccacggaactgacgcagtcgcagatgctgcatatagcccagcagatc
gccgcgggcatggtctacctggcgtcccagcacttcgtgcaccgcgatttggccaccaggaactgcctggtcggggag
aacttgctggtgaaaatcggggactttgggatgtcccgggacgtgtacagcactgactactacagggtcggtggccaca
caatgctgcccattcgctggatgcctccagagagcatcatgtacaggaaattcacgacggaaagcgacgtctggagcc
tgggggtcgtgttgtgggagattttcacctatggcaaacagccctggtaccagctgtcaaacaatgaggtgatagagtgt
atcactcagggccgagtcctgcagcgaccccgcacgtgcccccaggaggtgtatgagctgatgctggggtgctggcag
cgagagccccacatgaggaagaacatcaagggcatccataccctccttcagaacttggccaaggcatctccggtctac
ctggacattctaggctag FIG. 30B (continued)

MEEQGHSEMEIIPSESHPHIQLLKSNRELLVTHIRNTQCLVDNLLKNDYFSAEDAEIVC
ACPTQPDKVRKILDLVQSKGEEVSEFFLYLLQQLADAYVDLRPWLLEIGFSPSLLTQSK
VVVNTDPVSRYTQQLRHHLGRDSKFVLCYAQKEELLLEEIYMDTIMELVGFSNESLGS
LNSLACLLDHTTGILNEQGETIFILGDAGVGKSMLLQRLQSLWATGRLDAGVKFFFHF
RCRMFSCFKESDRLCLQDLLFKHYCYPERDPEEVFAFLLRFPHVALFTFDGLDELHS
DLDLSRVPDSSCPWEPAHPLVLLANLLSGKLLKGASKLLTARTGIEVPRQFLRKKVLLR
GFSPSHLRAYARRMFPERALQDRLLSQLEANPNLCSLCSVPLFCWIIFRCFQHFRAAF
EGSPQLPDCTMTLTDVFLLVTEVHLNRMQPSSLVQRNTRSPVETLHAGRDTLCSLGQ
VAHRGMEKSLFVFTQEEVQASGLQERDMQLGFLRALPELGPGGDQQSYEFFHLTLQ
AFFTAFFLVLDDRVGTQELLRFFQEWMPPAGAATTSCYPPFLPFQCLQGSGPAREDL
FKNKDHFQFTNLFLCGLLSKAKQKLLRHLVPAAALRRKRKALWAHLFSSLRGYLKSLP
RVQVESFNQVQAMPTFIWMLRCIYETQSQKVGQLAARGICANYLKLTYCNACSADCS
ALSFVLHHFPKRLALDLDNNNLNDYGVRELQPCFSRLTVLRLSVNQITDGGVKVLSEE
LTKYKIVTYLGLYNNQITDVGARYVTKILDECKGLTHLKLGKNKITSEGGKYLALAVKNS
KSISEVGILVGNPFTCSCDIMWIKTLQEAKSSPDTQDLYCLNESSKNIPLANLQIPNCGL
PSANLAAPNLTVEEGKSITLSCSVAGDPVPNMYWDVGNLVSKHMNETSHTQGSLRIT
NISSDDSGKQISCVAENLVGEDQDSVNLTVHFAPTITFLESPTSDHHWCIPFTVKGNP
KPALQWFYNGAILNESKYICTKIHVTNHTEYHGCLQLDNPTHMNNGDYTLIAKNEYGK
DEKQISAHFMGWPGIDDGANPNYPDVIYEDYGTAANDIGDTTNRSNEIPSTDVTDKT
GREHLSVYAVVVIASVVGFCLLVMLFLLKLARHSKFGMKDFSWFGFGKVKSRQGVGP
ASVISNDDDSASPLHHISNGSNTPSSSEGGPDAVIIGMTKIPVIENPQYFGITNSQLKP
DTFVQHIKRHNIVLKRELGEGAFGKVFLAECYNLCPEQDKILVAVKTLKDASDNARKD
FHREAELLTNLQHEHIVKFYGVCVEGDPLIMVFEYMKHGDLNKFLRAHGPDAVLMAE
GNPPTELTQSQMLHIAQQIAAGMVYLASQHFVHRDLATRNCLVGENLLVKIGDFGMS
RDVYSTDYYRVGGHTMLPIRWMPPESIMYRKFTTESDVWSLGVVLWEIFTYGKQPW
YQLSNNEVIECITQGRVLQRPRTCPQEVYELMLGCWQREPHMRKNIKGIHTLLQNLA
KASPVYLDILG

FIG. 30C

ATGGCGGACGAGGCCCCGCGGAAGGGCAGCTTCTCGGCGCTCGTGGGCCGCA
CCAACGGCCTCACCAAGCCCGCGGCCCTGGCCGCCGCGCCCGCCAAGCCGGG
GGGCGCGGGCGGCTCCAAGAAGCTGGTCATCAAGAACTTCCGAGACACTAACAG
CACATCTGGAGACCCGGTGGAGAAGAAGGACGAAACACCTTTTGGGGTCTCGGT
GGCTGTGGGCCTGGCCGTCTTTGCCTGCCTCTTCCTTTCTACGCTGCTCCTTGTG
CTCAACAAATGTGGACGGAGAAACAAGTTTGGGATCAACCGCCCGGCTGTGCTG
GCTCCAGAGGATGGGCTGGCCATGTCCCTGCATTTCATGACATTGGGTGGCAGC
TCCCTGTCCCCCACCGAGGGCAAAGGCTCTGGGCTCCAAGGCCACATCATCGAG
AACCCACAATACTTCAGTGATGCCTGTGTTCACCACATCAAGCGCCGGGACATCG
TGCTCAAGTGGGAGCTGGGGGAGGGCGCCTTTGGGAAGGTCTTCCTTGCTGAG
TGCCACAACCTCCTGCCTGAGCAGGACAAGATGCTGGTGGCTGTCAAGGCACTG
AAGGAGGCGTCCGAGAGTGCTCGGCAGGACTTCCAGCGTGAGGCTGAGCTGCT
CACCATGCTGCAGCACCAGCACATCGTGCGCTTCTTCGGCGTCTGCACCGAGGG
CCGCCCCCTGCTCATGGTCTTTGAGTATATGCGGCACGGGGACCTCAACCGCTTC
CTCCGATCCCATGGACCTGATGCCAAGCTGCTGGCTGGTGGGGAGGATGTGGCT
CCAGGCCCCCTGGGTCTGGGGCAGCTGCTGGCCGTGGCTAGCCAGGTCGCTGC
GGGGATGGTGTACCTGGCGGGTCTGCATTTTGTGCACCGGGACCTGGCCACACG
CAACTGTCTAGTGGGCCAGGGACTGGTGGTCAAGATTGGTGATTTTGGCATGAG
CAGGGATATCTACAGCACCGACTATTACCGTGTGGGAGGCCGCACCATGCTGCCC
ATTCGCTGGATGCCGCCCGAGAGCATCCTGTACCGTAAGTTCACCACCGAGAGC
GACGTGTGGAGCTTCGGCGTGGTGCTCTGGGAGATCTTCACCTACGGCAAGCAG
CCCTGGTACCAGCTCTCCAACACGGAGGCAATCGACTGCATCACGCAGGGACGT
GAGTTGGAGCGGCCACGTGCCTGCCCACCAGAGGTCTACGCCATCATGCGGGG
CTGCTGGCAGCGGGAGCCCCAGCAACGCCACAGCATCAAGGATGTGCACGCCC
GGCTGCAAGCCCTGGCCCAGGCACCTCCTGTCTACCTGGATGTCCTGGGCTAG

FIG. 31A

MADEAPRKGSFSALVGRTNGLTKPAALAAAPAKPGGAGGSKKLVIKNFRDTNSTSGD
PVEKKDETPFGVSVAVGLAVFACLFLSTLLLVLNKCGRRNKFGINRPAVLAPEDGLAM
SLHFMTLGGSSLSPTEGKGSGLQGHIIENPQYFSDACVHHIKRRDIVLKWELGEGAF
GKVFLAECHNLLPEQDKMLVAVKALKEASESARQDFQREAELLTMLQHQHIVRFFGV
CTEGRPLLMVFEYMRHGDLNRFLRSHGPDAKLLAGGEDVAPGPLGLGQLLAVASQV
AAGMVYLAGLHFVHRDLATRNCLVGQGLVVKIGDFGMSRDIYSTDYYRVGGRTMLPI
RWMPPESILYRKFTTESDVWSFGVVLWEIFTYGKQPWYQLSNTEAIDCITQGRELER
PRACPPEVYAIMRGCWQREPQQRHSIKDVHARLQALAQAPPVYLDVLG

FIG. 31B

ATGCCTAGCAAAACCAAGTACAACCTTGTGGACGATGGGCACGACCTGCGGATCC
CCTTGCACAACGAGGACGCCTTCCAGCACGGCATCTGCTTTGAGGCCAAGTACG
TAGGAAGCCTGGACGTGCCAAGGCCCAACAGCAGGGTGGAGATCGTGGCTGCC
ATGCGCCGGATACGGTATGAGTTTAAAGCCAAGAACATCAAGAAGAAGAAAGTGA
GCATTATGGTTTCAGTGGATGGAGTGAAAGTGATTCTGAAGAAGAAGAAAAAGCT
TCTTTTATTGCAGAAAAAGGAATGGACGTGGGATGAGAGCAAGATGCTGGTGATG
CAGGACCCCATCTACAGGATCTTCTATGTCTCTCATGATTCCCAAGACTTGAAGAT
CTTCAGCTATATCGCTCGAGATGGTGCCAGCAATATCTTCAGGTGTAACGTCTTTA
AATCCAAGAAGAAGAGCCAAGCTATGAGAATCGTTCGGACGGTGGGGCAGGCCT
TTGAGGTCTGCCACAAGCTGAGCCTGCAGCACACGCAGCAGAATGCAGATGGCC
AGGAAGATGGAGAGAGCGAGAGGAACAGCAACAGCTCAGGAGACCCAGGCCGC
CAGCTCACTGGAGCCGAGAGGGCCTCCACGGCCACTGCAGAGGAGACTGACAT
CGATGCGGTGGAGGTCCCACTTCCAGGGAATGATGTCCTGGAATTCAGCCGAGG
TGTGACTGATCTAGATGCTGTAGGGAAGGAAGGAGGCTCTCACACAGGCTCCAA
GGTTTCGCACCCCCAGGAGCCCATGCTGACAGCCTCACCCAGGATGCTGCTCCC
TTCTTCTTCCTCGAAGCCTCCAGGCCTGGGCACAGAGACACCGCTGTCCACTCA
CCACCAGATGCAGCTCCTCCAGCAGCTCCTCCAGCAGCAGCAGCAGACACA
AGTGGCTGTGGCCCAGGTACACTTGCTGAAGGACCAGTTGGCTGCTGAGGCTGC
GGCGCGGCTGGAGGCCCAGGCTCGCGTGCATCAGCTTTTGCTGCAGAACAAGG
ACATGCTCCAGCACATCTCCCTGCTGGTCAAGCAGGTGCAAGAGCTGGAACTGA
AGCTGTCAGGACAGAACGCCATCTCCTTCTCGCCGGTGGACACTAACAGCACATC
TGGAGACCCGGTGGAGAAGAAGGACGAAACACCTTTTGGGGTCTCGGTGGCTG
TGGGCCTGGCCGTCTTTGCCTGCCTCTTCCTTTCTACGCTGCTCCTTGTGCTCAA
CAAATGTGGACGGAGAAACAAGTTTGGGATCAACCGCCCGGCTGTGCTGGCTCC
AGAGGATGGGCTGGCCATGTCCCTGCATTTCATGACATTGGGTGGCAGCTCCCT
GTCCCCCACCGAGGGCAAAGGCTCTGGGCTCCAAGGCCACATCATCGAGAACCC
ACAATACTTCAGTGATGCCTGTGTTCACCACATCAAGCGCCGGGACATCGTGCTC
AAGTGGGAGCTGGGGGAGGGCGCCTTTGGAAGGTCTTCCTTGCTGAGTGCCA
CAACCTCCTGCCTGAGCAGGACAAGATGCTGGTGGCTGTCAAGGCACTGAAGGA
GGCGTCCGAGAGTGCTCGGCAGGACTTCCAGCGTGAGGCTGAGCTGCTCACCA
TGCTGCAGCACCAGCACATCGTGCGCTTCTTCGGCGTCTGCACCGAGGGCCGC
CCCCTGCTCATGGTCTTTGAGTATATGCGGCACGGGGACCTCAACCGCTTCCTCC
GATCCCATGGACCTGATGCCAAGCTGCTGGCTGGTGGGGAGGATGTGGCTCCAG
GCCCCCTGGGTCTGGGGCAGCTGCTGGCCGTGGCTAGCCAGGTCGCTGCGGG
GATGGTGTACCTGGCGGGTCTGCATTTTGTGCACCGGGACCTGGCCACACGCAA
CTGTCTAGTGGGCCAGGGACTGGTGGTCAAGATTGGTGATTTTGGCATGAGCAG
GGATATCTACAGCACCGACTATTACCGTGTGGGAGGCCGCACCATGCTGCCCATT
CGCTGGATGCCGCCCGAGAGCATCCTGTACCGTAAGTTCACCACCGAGAGCGAC
GTGTGGAGCTTCGGCGTGGTGCTCTGGGAGATCTTCACCTACGGCAAGCAGCCC
TGGTACCAGCTCTCCAACACGGAGGCAATCGACTGCATCACGCAGGGACGTGAG
TTGGAGCGGCCACGTGCCTGCCCACCAGAGGTCTACGCCATCATGCGGGGCTG
CTGGCAGCGGGAGCCCCAGCAACGCCACAGCATCAAGGATGTGCACGCCCGGC
TGCAAGCCCTGGCCCAGGCACCTCCTGTCTACCTGGATGTCCTGGGCTAG

FIG. 32A

MPSKTKYNLVDDGHDLRIPLHNEDAFQHGICFEAKYVGSLDVPRPNSRVEIVAAMRRI
RYEFKAKNIKKKKVSIMVSVDGVKVILKKKKKLLLLQKKEWTWDESKMLVMQDPIYRIF
YVSHDSQDLKIFSYIARDGASNIFRCNVFKSKKKSQAMRIVRTVGQAFEVCHKLSLQH
TQQNADGQEDGESERNSNSSGDPGRQLTGAERASTATAEETDIDAVEVPLPGNDVL
EFSRGVTDLDAVGKEGGSHTGSKVSHPQEPMLTASPRMLLPSSSSKPPGLGTETPL
STHHQMQLLQQLLQQQQQTQVAVAQVHLLKDQLAAEAAARLEAQARVHQLLLQNK
DMLQHISLLVKQVQELELKLSGQNAISFSPVDTNSTSGDPVEKKDETPFGVSVAVGLA
VFACLFLSTLLLVLNKCGRRNKFGINRPAVLAPEDGLAMSLHFMTLGGSSLSPTEGKG
SGLQGHIIENPQYFSDACVHHIKRRDIVLKWELGEGAFGKVFLAECHNLLPEQDKMLV
AVKALKEASESARQDFQREAELLTMLQHQHIVRFFGVCTEGRPLLMVFEYMRHGDLN
RFLRSHGPDAKLLAGGEDVAPGPLGLGQLLAVASQVAAGMVYLAGLHFVHRDLATRN
CLVGQGLVVKIGDFGMSRDIYSTDYYRVGGRTMLPIRWMPPESILYRKFTTESDVWS
FGVVLWEIFTYGKQPWYQLSNTEAIDCITQGRELERPRACPPEVYAIMRGCWQREPQ
QRHSIKDVHARLQALAQAPPVYLDVLG

FIG. 32B

ATGCTGCGAGGCGGACGGCGCGGGCAGCTTGGCTGGCACAGCTGGGCTGCGG
GGCCGGGCAGCCTGCTGGCTTGGCTGATACTGGCATCTGCGGGCGCCGCACCC
TGCCCCGATGCCTGCTGCCCCCACGGCTCCTCGGGACTGCGATGCACCCGGGA
TGGGGCCCTGGATAGCCTCCACCACCTGCCCGGCGCAGAGAACCTGACTGAGC
TCTACATCGAGAACCAGCAGCATCTGCAGCATCTGGAGCTCCGTGATCTGAGGG
GCCTGGGGGAGCTGAGAAACCTCACCATCGTGAAGAGTGGTCTCCGTTTCGTGG
CGCCAGATGCCTTCCATTTCACTCCTCGGCTCAGTCGCCTGAATCTCTCCTTCAA
CGCTCTGGAGTCTCTCTCCTGGAAAACTGTGCAGGGCCTCTCCTTACAGGAACT
GGTCCTGTCGGGGAACCCTCTGCACTGTTCTTGTGCCCTGCGCTGGCTACAGCG
CTGGGAGGAGGAGGGACTGGGCGGAGTGCCTGAACAGAAGCTGCAGTGTCATG
GGCAAGGGCCCCTGGCCCACATGCCCAATGCCAGCTGTGGTGTGCCCACGCTG
AAGGTCCAGGTGCCCAATGCCTCGGTGGATGTGGGGGACGACGTGCTGCTGCG
GTGCCAGGTGGAGGGGCGGGGCCTGGAGCAGGCCGGCTGGATCCTCACAGAG
CTGGAGCAGTCAGCCACGGTGATGAAATCTGGGGGTCTGCCATCCCTGGGGCTG
ACCCTGGCCAATGTCACCAGTGACCTCAACAGGAAGAACGTGACGTGCTGGGCA
GAGAACGATGTGGGCCGGGCAGAGGTCTCTGTTCAGGTCAACGTCTCCTTCCCG
GCCAGTGTGCAGCTGCACACGGCGGTGGAGATGCACCACTGGTGCATCCCCTTC
TCTGTGGATGGGCAGCCGGCACCGTCTCTGCGCTGGCTCTTCAATGGCTCCGTG
CTCAATGAGACCAGCTTCATCTTCACTGAGTTCCTGGAGCCGGCAGCCAATGAGA
CCGTGCGGCACGGGTGTCTGCGCCTCAACCAGCCCACCCACGTCAACAACGGC
AACTACACGCTGCTGGCTGCCAACCCCTTCGGCCAGGCCTCCGCCTCCATCATG
GCTGCCTTCATGGACAACCCTTTCGAGTTCAACCCCGAGGACCCCATCCCTGTCT
CCTTCTCGCCGGTGGACACTAACAGCACATCTGGAGACCCGGTGGAGAAGAAGG
ACGAAACACCTTTTGGGGTCTCGGTGGCTGTGGGCCTGGCCGTCTTTGCCTGCC
TCTTCCTTTCTACGCTGCTCCTTGTGCTCAACAAATGTGGACGGAGAAACAAGTTT
GGGATCAACCGTGCGAAGCCCAGCGGTGCAGAGTCCAGCAAAGGTGCAGCCTT
TGTGTCCAAGCAGGAGGGCAGCGAGGTAGTGAAGAGACCCAGGCGCTACCTGTA
TCAATGGCTGGGAGCCCCAGTCCCCTACCCGGATCCCCTGGAGCCCAGGAGGG
AGGTGTGTGAGCTCAATCCGGACTGTGACGAGTTGGCTGACCACATCGGCTTTC
AGGAGGCCTATCGGCGCTTCTACGGCCCGGTCTAG

FIG. 33A

MLRGGRRGQLGWHSWAAGPGSLLAWLILASAGAAPCPDACCPHGSSGLRCTRDG
ALDSLHHLPGAENLTELYIENQQHLQHLELRDLRGLGELRNLTIVKSGLRFVAPDAFHF
TPRLSRLNLSFNALESLSWKTVQGLSLQELVLSGNPLHCSCALRWLQRWEEEGLGG
VPEQKLQCHGQGPLAHMPNASCGVPTLKVQVPNASVDVGDDVLLRCQVEGRGLEQ
AGWILTELEQSATVMKSGGLPSLGLTLANVTSDLNRKNVTCWAENDVGRAEVSVQV
NVSFPASVQLHTAVEMHHWCIPFSVDGQPAPSLRWLFNGSVLNETSFIFTEFLEPAAN
ETVRHGCLRLNQPTHVNNGNYTLLAANPFGQASASIMAAFMDNPFEFNPEDPIPVSF
SPVDTNSTSGDPVEKKDETPFGVSVAVGLAVFACLFLSTLLLVLNKCGRRNKFGINRA
KPSGAESSKGAAFVSKQEGSEVVKRPRRYLYQWLGAPVPYPDPLEPRREVCELNPD
CDELADHIGFQEAYRRFYGPV

FIG. 33B

ATGGGTGTAAAGAAGAAGAAAGAAATGCAAGTTGCTGCGCTGACCATTTGCCATC
AGGACCTTGAAACTTTGAAATCTTTTGCTGATGTGGAAGGGAAAAATCTAGCTTCT
TTGCTGTTACATTGTGTGCAACTCACGGATGGAGTGTCACAAATCCATTATATTAAA
CAGATTGTGCCTCTGCTGGAGAAAGCAGATAAAAATGGCATGTGTGATCCCACTAT
TCAAAGTTGTTTGGATATCTTAGCAGGCATTTATCTTTCTTTGAGTCTAAAGAATCC
CTTGAAGAAAGTATTGGCAAGCTCACTAAATAGCCTGCCTGATTTTTTTCTACCTGA
GGCTATGCACCGTTTTACTTCTCGTCTTCAGGAAGAATTGAATACTACTGACTTATA
CTCTTACAGGAAAGTTACTGACAATATTTCTTCCTGTATGGAGAACTTTAACTTGGG
TAGAGCAAGTGTTAATAATCTGCTTAAAAATGTGCTTCATTTTCTGCAGAAGAGTTT
AATTGAAATCCTGGAAGAAAATAGAAAATGTGCTGGAAATCATATTATTCAAACACA
GTTGATGAATGACTTACTGGTAGGCATTAGAGTTTCAATGATGTTAGTACAGAAAGT
ACAAGATTTCCAGGGAAATCTTTGGAAGACTTCCGATTCTCCCATATGGCAAAATAT
GTGTGGATTGCTGAGTATTTTTACCAAGGTTTTAAGCGATGATGATCTGTTACAGA
CTGTACAGAGCACATCTGGATTAGCTATTATTCTTTTTATTAAGACTATGTTTCACCC
GTCTGAAAAGATTCCTCATTTGATTAGCAGTGTGCTGCTTCGTTCAGTGGACTGCA
CCAGTGTCCCCGAGTGGTTTATGAGCAGCTGCAGGAGCCTCTGTTGTGGTGACA
TCTCTCAGTCAGCTGTCTTATTCCTCTGTCAGGGGACACTTGCCATGTTGGACTG
GCAGAACGGAAGCATGGGTCGGAGTGGGGAGGCCCTGCTCTTGGATACTGCAC
ATGTTTTGTTCACCTTGAGTTCACAGATTAAAGAGCCAACGCTGGAAATGTTTCTG
TCTAGAATCTTAGCATCCTGGACTAATTCAGCCATACAAGTCCTTGAATCAAGTTCC
CCGAGCCTAACGGACAGCCTGAATGGGAATTCAAGTATAGTTGGGAGACTTTTGG
AATATGTCTATACCCATTGGGAACATCCATTGGATGCTCTGAGACACCAAACCAAA
ATCATGTTCAAAAACCTTCTCCAAATGCACCGGCTCACTGTGGAAGGTGCAGATTT
CGTCCCTGATCCTTTCTTTGTGGAATTGACTGAGAGTCTTTTACGATTGGAATGGC
ATATTAAAGGAAAGTACACGTGCCTTGGTTGTTTGGTAGAGTGCATAGGAGTTGAA
CATATTTTGGCTATAGATAAAACTATTCCATCTCAAATCTTAGAGGTGATGGGAGAC
CAGTCATTGGTACCTTATGCAAGTGACCTCTTGGAAACCATGTTTAGAAATCATAAG
AGTCATTTGAAATCCCAGACTGCTGAGAGTTCTTGGATTGACCAGTGGCATGAGA
CTTGGGTTTCTCCTCTCCTTTTTATATTGTGTGAAGGAAACTTGGATCAAAAATCTT
ACGTGATTGATTATTACTTGCCAAAATTATTAAGTTACAGCCCTGAAAGCTTACAGT
ACATGGTAAAGATTCTTCAGACTTCTATTGATGCTAAAACTGGACAAGAGCAATCTT
TCCCATCCTTAGGGTCTTGTAATAGCAGGGGGGCTCTGGGAGCTTTGATGGCATG
TCTGCGAATAGCTAGAGCTCATGGACATCTTCAGTCTGCAACTGATACCTGGGAG
AACCTCGTGTCTGATGCAAGAATAAAGCAAGGCTTAATTCATCAGCATTGCCAAGT
AAGGATAGATACATTAGGCTTGCTTTGTGAAAGTAATCGGAGCACAGAAATTGTTT
CCATGGAAGAAATGCAGTGGATTCAGTTCTTTATTACATACAATCTTAACAGCCAGT
CTCCAGGAGTGCGGCAACAGATCTGTTCTCTTCTTAAAAAGTTGTTTTGTAGGATA
CAGGAAAGTTCTCAGGTACTTTATAAATTGGAGCAGAGTAAATCCAAACGTGAACC
AGAGAATGAGTTAACCAAACAGCACCCTTCTGTTTCTTTACAGCAGTATAAGAATTT
CATGTCATCCATTTGTAACAGTCTTTTTGAAGCATTGTTTCCTGGATCTTCCTACTC
GACTAGATTTTCAGCTTTAACCATTTTAGGTTCAATAGCTGAAGTTTTTCATGTCCC

FIG. 34A

AGAAGGCAGAATTTATACAGTATATCAGCTGAGTCATGATATTGATGTTGGTCGTTT
CCAAACACTAATGGAATGTTTTACCAGCACTTTTGAAGACGTGAAAATTTTAGCATT
TGATCTTCTGATGAAGTTATCAAAAACAGCTGTACATTTTCAGGATTCGGGGAAAC
TGCAAGGCTTATTTCAGGCAGCATTGGAGCTCAGCACAAGCACCAAACCATACGA
CTGTGTGACAGCTTCCTACCTGCTGAACTTCTTAATCTGGCAGGATGCTCTACCGT
CATCCTTGTCTGCCTACTTAACTCAGCAAGTTGCATGTGATAATGGAGATAGGCCT
GCTGCTGTGGTGGAAAGGAACACATTAATGGTTATCAAATGCTTGATGGAAAATCT
TGAGGAAGAAGTATCTCAGGCTGAAAATTCTCTGCTTCAGGCAGCAGCAGCATTT
CCAATGTATGGGCGAGTCCACTGTATAACAGGAGCTTTGCAGAAGTTATCTCTAAA
CAGCCTGCAGTTGGTGAGCGAGTGGAGACCTGTGGTAGAGAAGCTCCTTTTGAT
GTCCTACAGGCTTTCCACTGTGGTGTCTCCAGTCATTCAGAGCTCATCCCCTGAA
GGCCTCATCCCAATGGACACTGATTCAGAGTCAGCAAGCCGCTTACAGATGATTC
TGAATGAGATTCAGCCTCGAGATACTAATGATTATTTTAACCAAGCCAAAATATTGA
AAGAACATGATAGCTTTGATATGAAGGACTTGAATGCTAGTGTGGTGAATATTGATA
CTTCTACAGAAATCAAAGGTAAAGAAGTAAAAACATGTGATGTAACTGCGCAGATG
GTGCTGGTATGTTGTTGGAGAAGTATGAAGGAAGTTGCTTTACTTTTAGGCATGTT
GTGCCAGCTTCTGCCCATGCAGCCTGTGCCAGAATCTTCTGATGGATTATTGACG
GTGGAGCAGGTAAAAGAAATAGGAGATTACTTTAAACAACACCTTTTGCAGTCCAG
GCACAGAGGAGCATTTGAATTGGCTTATACTGGTTTTGTGAAACTCACTGAAGTAC
TAAACAGGTGCCCAAATGTGAGTCTGCAAAAGCTGCCAGAACAGTGGCTATGGAG
TGTTTTAGAGGAAATTAAATGCAGTGATCCTTCATCTAAACTCTGTGCTACAAGGC
GCAGTGCTGGAATTCCTTTCTACATACAGGCACTGTTGGCATCTGAACCAAAGAAA
GGCAGAATGGATTTGTTGAAAATAACAATGAAAGAGTTAATCTCTTTGGCTGGGCC
TACAGATGACATACAGAGTACAGTCCCCCAGGTTCATGCTTTAAATATCCTTAGAGC
ATTGTTCAGAGATACGCGCCTGGGAGAAAATATTATTCCTTATGTTGCTGATGGAG
CTAAGGCTGCAATTCTGGGTTTTACATCACCGGTCTGGGCAGTGCGAAATTCATC
CACACTTCTCTTTAGTGCCTTGATCACAAGAATTTTTGGAGTTAAAAGGGCAAAGG
ATGAACATTCCAAAACAAATAGAATGACAGGGAGAGAGTTTTTCTCTCGTTTCCCA
GAACTCTATCCTTTTCTTCTCAAACAGTTGGAAACTGTAGCCAATACAGTAGACAG
TGATATGGGAGAACCAAATCGTCATCCAAGCATGTTTCTCTTACTTTTGGTGTTGG
AGAGACTCTACGCTTCCCCGATGGATGGTACTTCTTCTGCTCTCAGCATGGGACC
TTTTGTTCCCTTCATTATGAGGTGTGGTCACTCACCTGTCTACCACTCCCGTGAAA
TGGCAGCTCGTGCCTTGGTCCCATTTGTTATGATAGATCACATTCCTAATACCATTC
GAACTCTGTTGTCCACACTCCCCAGCTGCACTGACCAGTGTTTCCGGCAAAACCA
CATTCATGGGACACTTCTCCAGGTTTTTCATTTGTTGCAAGCCTACTCAGACTCCA
AACACGGAACGAATTCAGACTTCCAGCACGAGCTGACTGACATCACTGTTTGTAC
CAAAGCCAAACTCTGGCTGGCCAAGAGGCAAAATCCATGTTTGGTGACCAGAGC
TGTATATATTGATATTCTCTTCCTATTGACTTGCTGCCTCAACAGATCTGCAAAGGA
CAACCAGCCAGTTCTGGAGAGTCTTGGCTTCTGGGAGGAAGTCAGAGGGATTAT
CTCAGGATCAGAGCTGATAACGGGATTCCCTTGGGCCTTCAAGGTGCCAGGCCT
GCCCCAGTACCTCCAGAGCCTCACCAGACTAGCCATTGCTGCAGTGTGGGCCGC
GGCAGCCAAGAGTGGAGAGCGGGAGACGAATGTCCCCATCTCTTTCTCTCAGCT

FIG. 34A (continued)

GTTAGAATCTGCCTTCCCTGAAGTGCGCTCACTAACACTGGAAGCCCTCTTGGAA
AAGTTCTTAGCAGCAGCCTCTGGACTTGGAGAGAAGGGCGTGCCACCCTTGCTG
TGCAACATGGAGAGAAGTTCTTATTGTTGGCCATGAAGGAAAATCACCCAGAAT
GCTTCTGCAAGATACTGAAAATTCTCCACTGCATGGACCCTGGTGAGTGGCTTCC
CCAGACGGAGCACTGTGTCCATCTGACCCCAAAGGAGTTCTTGATCTGGACGAT
GGATATTGCTTCCAATGAAAGATCTGAAATTCAGAGTGTAGCTCTGAGACTTGCTT
CCAAAGTCATTTCCCACCACATGCAGACATGTGTGGAGAACAGGGAATTGATAGC
TGCTGAGCTGAAGCAGTGGGTTCAGCTGGTCATCTTGTCATGTGAAGACCATCTT
CCTACAGAGTCTAGGCTGGCCGTCGTTGAAGTCCTCACCAGTACTACACCACTTT
TCCTCACCAACCCCCATCCTATTCTTGAGTTGCAGGATACACTTGCTCTCTGGAAG
TGTGTCCTTACCCTTCTGCAGAGTGAGGAGCAAGCTGTTAGAGATGCAGCCACG
GAAACCGTGACAACTGCCATGTCACAAGAAAATACCTGCCAGTCAACAGGTGCAA
ACCCAAATTATCCTGATGTAATTTATGAAGATTATGGAACTGCAGCGAATGACATCG
GGGACACCACGAACAGAAGTAATGAAATCCCTTCCACAGACGTCACTGATAAAAC
CGGTCGGGAACATCTCTCGGTCTATGCTGTGGTGGTGATTGCGTCTGTGGTGGG
ATTTTGCCTTTTGGTAATGCTGTTTCTGCTTAAGTTGGCAAGACACTCCAAGTTTG
GCATGAAAGATTTCTCATGGTTTGGATTTGGGAAAGTAAAATCAAGACAAGGTGTT
GGCCCAGCCTCCGTTATCAGCAATGATGATGACTCTGCCAGCCCACTCCATCACA
TCTCCAATGGGAGTAACACTCCATCTTCTTCGGAAGGTGGCCCAGATGCTGTCAT
TATTGGAATGACCAAGATCCCTGTCATTGAAAATCCCCAGTACTTTGGCATCACCA
ACAGTCAGCTCAAGCCAGACACATTTGTTCAGCACATCAAGCGACATAACATTGTT
CTGAAAAGGGAGCTAGGCGAAGGAGCCTTTGGAAAAGTGTTCCTAGCTGAATGC
TATAACCTCTGTCCTGAGCAGGACAAGATCTTGGTGGCAGTGAAGACCCTGAAGG
ATGCCAGTGACAATGCACGCAAGGACTTCCACCGTGAGGCCGAGCTCCTGACCA
ACCTCCAGCATGAGCACATCGTCAAGTTCTATGGCGTCTGCGTGGAGGGCGACC
CCCTCATCATGGTCTTTGAGTACATGAAGCATGGGGACCTCAACAAGTTCCTCAG
GGCACACGGCCCTGATGCCGTGCTGATGGCTGAGGGCAACCCGCCCACGGAAC
TGACGCAGTCGCAGATGCTGCATATAGCCCAGCAGATCGCCGCGGGCATGGTCT
ACCTGGCGTCCCAGCACTTCGTGCACCGCGATTTGGCCACCAGGAACTGCCTGG
TCGGGGAGAACTTGCTGGTGAAAATCGGGGACTTTGGGATGTCCCGGGACGTGT
ACAGCACTGACTACTACAGGGTCGGTGGCCACACAATGCTGCCCATTCGCTGGAT
GCCTCCAGAGAGCATCATGTACAGGAAATTCACGACGGAAAGCGACGTCTGGAG
CCTGGGGGTCGTGTTGTGGGAGATTTTCACCTATGGCAAACAGCCCTGGTACCA
GCTGTCAAACAATGAGGTGATAGAGTGTATCACTCAGGGCCGAGTCCTGCAGCG
ACCCCGCACGTGCCCCCAGGAGGTGTATGAGCTGATGCTGGGGTGCTGGCAGC
GAGAGCCCCACATGAGGAAGAACATCAAGGGCATCCATACCCTCCTTCAGAACTT
GGCCAAGGCATCTCCGGTCTACCTGGACATTCTAGGCTAG

FIG. 34A (continued)

MGVKKKKEMQVAALTICHQDLETLKSFADVEGKNLASLLLHCVQLTDGVSQIHYIKQIV
PLLEKADKNGMCDPTIQSCLDILAGIYLSLSLKNPLKKVLASSLNSLPDFFLPEAMHRF
TSRLQEELNTTDLYSYRKVTDNISSCMENFNLGRASVNNLLKNVLHFLQKSLIEILEEN
RKCAGNHIIQTQLMNDLLVGIRVSMMLVQKVQDFQGNLWKTSDSPIWQNMCGLLSIF
TKVLSDDDLLQTVQSTSGLAIILFIKTMFHPSEKIPHLISSVLLRSVDCTSVPEWFMSSC
RSLCCGDISQSAVLFLCQGTLAMLDWQNGSMGRSGEALLLDTAHVLFTLSSQIKEPT
LEMFLSRILASWTNSAIQVLESSSPSLTDSLNGNSSIVGRLLEYVYTHWEHPLDALRH
QTKIMFKNLLQMHRLTVEGADFVPDPFFVELTESLLRLEWHIKGKYTCLGCLVECIGV
EHILAIDKTIPSQILEVMGDQSLVPYASDLLETMFRNHKSHLKSQTAESSWIDQWHET
WVSPLLFILCEGNLDQKSYVIDYYLPKLLSYSPESLQYMVKILQTSIDAKTGQEQSFPS
LGSCNSRGALGALMACLRIARAHGHLQSATDTWENLVSDARIKQGLIHQHCQVRIDTL
GLLCESNRSTEIVSMEEMQWIQFFITYNLNSQSPGVRQQICSLLKKLFCRIQESSQVL
YKLEQSKSKREPENELTKQHPSVSLQQYKNFMSSICNSLFEALFPGSSYSTRFSALTI
LGSIAEVFHVPEGRIYTVYQLSHDIDVGRFQTLMECFTSTFEDVKILAFDLLMKLSKTA
VHFQDSGKLQGLFQAALELSTSTKPYDCVTASYLLNFLIWQDALPSSLSAYLTQQVAC
DNGDRPAAVVERNTLMVIKCLMENLEEEVSQAENSLLQAAAAFPMYGRVHCITGALQ
KLSLNSLQLVSEWRPVVEKLLLMSYRLSTVVSPVIQSSSPEGLIPMDTDSESASRLQM
ILNEIQPRDTNDYFNQAKILKEHDSFDMKDLNASVVNIDTSTEIKGKEVKTCDVTAQMV
LVCCWRSMKEVALLLGMLCQLLPMQPVPESSDGLLTVEQVKEIGDYFKQHLLQSRHR
GAFELAYTGFVKLTEVLNRCPNVSLQKLPEQWLWSVLEEIKCSDPSSKLCATRRSAGI
PFYIQALLASEPKKGRMDLLKITMKELISLAGPTDDIQSTVPQVHALNILRALFRDTRLG
ENIIPYVADGAKAAILGFTSPVWAVRNSSTLLFSALITRIFGVKRAKDEHSKTNRMTGR
EFFSRFPELYPFLLKQLETVANTVDSDMGEPNRHPSMFLLLLVLERLYASPMDGTSSA
LSMGPFVPFIMRCGHSPVYHSREMAARALVPFVMIDHIPNTIRTLLSTLPSCTDQCFR
QNHIHGTLLQVFHLLQAYSDSKHGTNSDFQHELTDITVCTKAKLWLAKRQNPCLVTRA
VYIDILFLLTCCLNRSAKDNQPVLESLGFWEEVRGIISGSELITGFPWAFKVPGLPQYL
QSLTRLAIAAVWAAAAKSGERETNVPISFSQLLESAFPEVRSLTLEALLEKFLAAASGL
GEKGVPPLLCNMGEKFLLLAMKENHPECFCKILKILHCMDPGEWLPQTEHCVHLTPK
EFLIWTMDIASNERSEIQSVALRLASKVISHHMQTCVENRELIAAELKQWVQLVILSCE
DHLPTESRLAVVEVLTSTTPLFLTNPHPILELQDTLALWKCVLTLLQSEEQAVRDAATE
TVTTAMSQENTCQSTGANPNYPDVIYEDYGTAANDIGDTTNRSNEIPSTDVTDKTGR
EHLSVYAVVVIASVVGFCLLVMLFLLKLARHSKFGMKDFSWFGFGKVKSRQGVGPAS
VISNDDDSASPLHHISNGSNTPSSSEGGPDAVIIGMTKIPVIENPQYFGITNSQLKPDTF
VQHIKRHNIVLKRELGEGAFGKVFLAECYNLCPEQDKILVAVKTLKDASDNARKDFHR
EAELLTNLQHEHIVKFYGVCVEGDPLIMVFEYMKHGDLNKFLRAHGPDAVLMAEGNP
PTELTQSQMLHIAQQIAAGMVYLASQHFVHRDLATRNCLVGENLLVKIGDFGMSRDV
YSTDYYRVGGHTMLPIRWMPPESIMYRKFTTESDVWSLGVVLWEIFTYGKQPWYQL
SNNEVIECITQGRVLQRPRTCPQEVYELMLGCWQREPHMRKNIKGIHTLLQNLAKAS
PVYLDILG*

FIG. 34B

GCACAGCAGCTGCACGCGCCGTGGCTCCGGATCTCTTCGTCTTTGCAGCGTAGC
CCGAGTCGGTCAGCGCCGGAGACACATAGAGAACTGGCGCAGTCTTCACACGCT
CAACGCCGTGGACATGGAGCTCTACACCGGACTTCAAAAGCTGACCATCAAGAAC
TCAGGACTTCGGAGCATTCAGCCCAGAGCCTTTGCCAAGAACCCCCATTTGCGTT
ATATAAACCTGTCAAGTAACCGGCTCACCACACTCTCGTGGCAGCTCTTCCAGAC
GCTGAGTCTTCGGGAATTGCAGTTGGAGCAGAACTTTTTCAACTGCAGCTGTGAC
ATCCGCTGGATGCAGCTCTGGCAGGAGCAGGGGGAGGCCAAGCTCAACAGCCA
GAACCTCTACTGCATCAACGCTGATGGCTCCCAGCTTCCTCTCTTCCGCATGAAC
ATCAGTCAGTGTGACCTTCCTGAGATCAGCGTGAGCCACGTCAACCTGACCGTAC
GAGAGGGTGACAACGCTGTTATCACTTGCAATGGCTCTGGATCACCCCTTCCTGA
TGTGGACTGGATAGTCACTGGGCTGCAGTCCATCAACACTCACCAGACCAATCTG
AACTGGACCAATGTTCATGCCATCAACTTGACGCTGGTGAATGTGACGAGTGAGG
ACAATGGCTTCACCCTGACGTGCATTGCAGAGAACGTGGTGGGCATGAGCAATG
CCAGTGTTGCCCTCACTGTCTACTATCCCCCACGTGTGGTGAGCCTGGAGGAGC
CTGAGCTGCGCCTGGAGCACTGCATCGAGTTTGTGGTGCGTGGCAACCCCCCAC
CAACGCTGCACTGGCTGCACAATGGGCAGCCTCTGCGGGAGTCCAAGATCATCC
ATGTGGAATACTACCAAGAGGGAGAGATTTCCGAGGGCTGCCTGCTCTTCAACAA
GCCCACCCACTACAACAATGGCAACTATACCCTCATTGCCAAAAACCCACTGGGC
ACAGCCAACCAGACCATCAATGGCCACTTCCTCAAGGAGCCCTTTCCAGAGAGCA
CGGATAACTTTATCTTGTTTGACGAAGTGAGTCCCACACCTCCTATCACTGTGACC
CACAAACCAGAAGAAGACACTTTTGGGGTATCCATAGCAGTTGGACTTGCTGCTT
TTGCCTGTGTCCTGTTGGTGGTTCTCTTCGTCATGATCAACAAATATGGTCGACGG
TCCAAATTTGGAATGAAGGGTCCCGTGGCTGTCATCAGTGGTGAGGAGGACTCA
GCCAGCCCACTGCACCACATCAACCACGGCATCACCACGCCCTCGTCACTGGAT
GCCGGGCCCGACACTGTGGTCATTGGCATGACTCGCATCCCTGTCATTGAGAAC
CCCCAGTACTTCCGTCAGGGACACAACTGCCACAAGCCGGACACGTATGTGCAG
CACATTAAGAGGAGAGACATCGTGCTGAAGCGAGAACTGGGTGAGGGAGCCTTT
GGAAAGGTCTTCCTGGCCGAGTGCTACAACCTCAGCCCGACCAAGGACAAGATG
CTTGTGGCTGTGAAGGCCCTGAAGGATCCCACCCTGGCTGCCCGGAAGGATTTC
CAGAGGGAGGCCGAGCTGCTCACCAACCTGCAGCATGAGCACATTGTCAAGTTC
TATGGAGTGTGCGGCGATGGGGACCCCCTCATCATGGTCTTTGAATACATGAAGC
ATGGAGACCTGAATAAGTTCCTCAGGGCCCATGGGCCAGATGCAATGATCCTTGT
GGATGGACAGCCACGCCAGGCCAAGGGTGAGCTGGGGCTCTCCCAAATGCTCC
ACATTGCCAGTCAGATCGCCTCGGGTATGGTGTACCTGGCCTCCCAGCACTTTGT
GCACCGAGACCTGGCCACCAGGAACTGCCTGGTTGGAGCGAATCTGCTAGTGAA
GATTGGGGACTTCGGCATGTCCAGAGATGTCTACAGCACGGATTATTACAGGGTG
GGAGGACACACCATGCTCCCCATTCGCTGGATGCCTCCTGAAAGCATCATGTACC
GGAAGTTCACTACAGAGAGTGATGTATGGAGCTTCGGGGTGATCCTCTGGGAGAT
CTTCACCTATGGAAAGCAGCCATGGTTCCAACTCTCAAACACGGAGGTCATTGAG
TGCATTACCCAAGGTCGTGTTTTGGAGCGGCCCCGAGTCTGCCCCAAAGAGGTG
TACGATGTCATGCTGGGGTGCTGGCAGAGGGAACCACAGCAGCGGTTGAACATC
AAGGAGATCTACAAAATCCTCCATGCTTTGGGGAAGGCCACCCCAATCTACCTGG
ACATTCTTGGCTAG

FIG. 35A

HSSCTRRGSGSLRLCSVARVGQRRRHIENWRSLHTLNAVDMELYTGLQKLTIKNSGL
RSIQPRAFAKNPHLRYINLSSNRLTTLSWQLFQTLSLRELQLEQNFFNCSCDIRWMQL
WQEQGEAKLNSQNLYCINADGSQLPLFRMNISQCDLPEISVSHVNLTVREGDNAVITC
NGSGSPLPDVDWIVTGLQSINTHQTNLNWTNVHAINLTLVNVTSEDNGFTLTCIAENV
VGMSNASVALTVYYPPRVVSLEEPELRLEHCIEFVVRGNPPPTLHWLHNGQPLRESKI
IHVEYYQEGEISEGCLLFNKPTHYNNGNYTLIAKNPLGTANQTINGHFLKEPFPESTDN
FILFDEVSPTPPITVTHKPEEDTFGVSIAVGLAAFACVLLVVLFVMINKYGRRSKFGMK
GPVAVISGEEDSASPLHHINHGITTPSSLDAGPDTVVIGMTRIPVIENPQYFRQGHNCH
KPDTYVQHIKRRDIVLKRELGEGAFGKVFLAECYNLSPTKDKMLVAVKALKDPTLAAR
KDFQREAELLTNLQHEHIVKFYGVCGDGDPLIMVFEYMKHGDLNKFLRAHGPDAMIL
VDGQPRQAKGELGLSQMLHIASQIASGMVYLASQHFVHRDLATRNCLVGANLLVKIG
DFGMSRDVYSTDYYRVGGHTMLPIRWMPPESIMYRKFTTESDVWSFGVILWEIFTYG
KQPWFQLSNTEVIECITQGRVLERPRVCPKEVYDVMLGCWQREPQQRLNIKEIYKILH
ALGKATPIYLDILG

FIG. 35B

ATGCTGCGAGGCGGACGGCGCGGGCAGCTTGGCTGGCACAGCTGGGCTGCGGGGCCGGGCAGCCTG
CTGGCTTGGCTGATACTGGCATCTGCGGGCGCCGCACCCTGCCCCGATGCCTGCTGCCCCCACGGCTCC
TCGGGACTGCGATGCACCCGGGATGGGGCCCTGGATAGCCTCCACCACCTGCCCGGCGCAGAGAACCT
GACTGAGCTCTACATCGAGAACCAGCAGCATCTGCAGCATCTGGAGCTCCGTGATCTGAGGGGCCTGG
GGGAGCTGAGAAACCTCACCATCGTGAAGAGTGGTCTCCGTTTCGTGGCGCCAGATGCCTTCCATTTCA
CTCCTCGGCTCAGTCGCCTGAATCTCTCCTTCAACGCTCTGGAGTCTCTCTCCTGGAAAACTGTGCAGGG
CCTCTCCTTACAGGAACTGGTCCTGTCGGGGAACCCTCTGCACTGTTCTTGTGCCCTGCGCTGGCTACAG
CGCTGGGAGGAGGAGGGACTGGGCGGAGTGCCTGAACAGAAGCTGCAGTGTCATGGGCAAGGGCCC
CTGGCCCACATGCCCAATGCCAGCTGTGGTGTGCCCACGCTGAAGGTCCAGGTGCCCAATGCCTCGGTG
GATGTGGGGGACGACGTGCTGCTGCGGTGCCAGGTGGAGGGGCGGGGCCTGGAGCAGGCCGGCTG
GATCCTCACAGAGCTGGAGCAGTCAGCCACGGTGATGAAATCTGGGGGTCTGCCATCCCTGGGGCTGA
CCCTGGCCAATGTCACCAGTGACCTCAACAGGAAGAACGTGACGTGCTGGGCAGAGAACGATGTGGG
CCGGGCAGAGGTCTCTGTTCAGGTCAACGTCTCCTTCCCGGCCAGTGTGCAGCTGCACACGGCGGTGG
AGATGCACCACTGGTGCATCCCCTTCTCTGTGGATGGGCAGCCGGCACCGTCTCTGCGCTGGCTCTTCA
ATGGCTCCGTGCTCAATGAGACCAGCTTCATCTTCACTGAGTTCCTGGAGCCGGCAGCCAATGAGACCG
TGCGGCACGGGTGTCTGCGCCTCAACCAGCCCACCCACGTCAACAACGGCAACTACACGCTGCTGGCT
GCCAACCCCTTCGGCCAGGCCTCCGCCTCCATCATGGCTGCCTTCATGGACAACCCTTTCGAGTTCAACC
CCGAGGACCCCATCCCTGTCTCCTTCTCGCCGGTGGACACTAACAGCACATCTGGAGACCCGGTGGAGA
AGAAGGACGAAACACCTTTTGGGGTCTCGGTGGCTGTGGGCCTGGCCGTCTTTGCCTGCCTCTTCCTTT
CTACGCTGCTCCTTGTGCTCAACAAATGTGGACGGAGAAACAAGTTTGGGATCAACCGCCCGGCTGTGC
TGGCTCCAGAGGATGGGCTGGCCATGTCCCTGCATTTCATGACATTGGGTGGCAGCTCCCTGTCCCCCA
CCGAGGGCAAAGGCTCTGGGCTCCAAGGCCACATCATCGAGAACCCACAATACTTCAGTGATGCCTGTG
TTCACCACATCAAGCGCCGGGACATCGTGCTCAAGTGGGAGCTGGGGGAGGGCGCCTTTGGGAAGGT
CTTCCTTGCTGAGTGCCACAACCTCCTGCCTGAGCAGGACAAGATGCTGGTGGCTGTCAAGGCACTGA
AGGAGGCGTCCGAGAGTGCTCGGCAGGACTTCCAGCGTGAGGCTGAGCTGCTCACCATGCTGCAGCA
CCAGCACATCGTGCGCTTCTTCGGCGTCTGCACCGAGGGCCGCCCCCTGCTCATGGTCTTTGAGTATATG
CGGCACGGGGACCTCAACCGCTTCCTCCGATCCCATGGACCTGATGCCAAGCTGCTGGCTGGTGGGGA
GGATGTGGCTCCAGGCCCCCTGGGTCTGGGGCAGCTGCTGGCCGTGGCTAGCCAGGTCGCTGCGGGG
ATGGTGTACCTGGCGGGTCTGCATTTTGTGCACCGGGACCTGGCCACACGCAACTGTCTAGTGGGCCA
GGGACTGGTGGTCAAGATTGGTGATTTTGGCATGAGCAGGGATATCTACAGCACCGACTATTACCGTGT
GGGAGGCCGCACCATGCTGCCCATTCGCTGGATGCCGCCCGAGAGCATCCTGTACCGTAAGTTCACCAC
CGAGAGCGACGTGTGGAGCTTCGGCGTGGTGCTCTGGGAGATCTTCACCTACGGCAAGCAGCCCTGGT
ACCAGCTCTCCAACACGGAGGCAATCGACTGCATCACGCAGGGACGTGAGTTGGAGCGGCCACGTGCC
TGCCCACCAGAGGTCTACGCCATCATGCGGGGCTGCTGGCAGCGGGAGCCCCAGCAACGCCACAGCAT
CAAGGATGTGCACGCCCGGCTGCAAGCCCTGGCCCAGGCACCTCCTGTCTACCTGGATGTCCTGGGCTA
G

FIG. 36A

ATGAAGGAGGCCGCCCTCATCTGCCTGGCACCCTCTGTACCCCCGATCTTGACGGTGAAGTCCTGGGAC
ACCATGCAGTTGCGGGCTGCTAGATCTCGGTGCACAAACTTGTTGGCAGCAAGCTACATCGAGAACCA
GCAGCATCTGCAGCATCTGGAGCTCCGTGATCTGAGGGGCCTGGGGGAGCTGAGAAACCTCACCATCG
TGAAGAGTGGTCTCCGTTTCGTGGCGCCAGATGCCTTCCATTTCACTCCTCGGCTCAGTCGCCTGAATCT
CTCCTTCAACGCTCTGGAGTCTCTCTCCTGGAAAACTGTGCAGGGCCTCTCCTTACAGGAACTGGTCCTG
TCGGGGAACCCTCTGCACTGTTCTTGTGCCCTGCGCTGGCTACAGCGCTGGGAGGAGGAGGGACTGG
GCGGAGTGCCTGAACAGAAGCTGCAGTGTCATGGGCAAGGGCCCCTGGCCCACATGCCCAATGCCAGC
TGTGGTGTGCCCACGCTGAAGGTCCAGGTGCCCAATGCCTCGGTGGATGTGGGGGACGACGTGCTGCT
GCGGTGCCAGGTGGAGGGGCGGGGCCTGGAGCAGGCCGGCTGGATCCTCACAGAGCTGGAGCAGTC
AGCCACGGTGATGAAATCTGGGGGTCTGCCATCCCTGGGGCTGACCCTGGCCAATGTCACCAGTGACCT
CAACAGGAAGAACGTGACGTGCTGGGCAGAGAACGATGTGGGCCGGGCAGAGGTCTCTGTTCAGGTC
AACGTCTCCTTCCCGGCCAGTGTGCAGCTGCACACGGCGGTGGAGATGCACCACTGGTGCATCCCCTTC
TCTGTGGATGGGCAGCCGGCACCGTCTCTGCGCTGGCTCTTCAATGGCTCCGTGCTCAATGAGACCAGC
TTCATCTTCACTGAGTTCCTGGAGCCGGCAGCCAATGAGACCGTGCGGCACGGGTGTCTGCGCCTCAAC
CAGCCCACCCACGTCAACAACGGCAACTACACGCTGCTGGCTGCCAACCCCTTCGGCCAGGCCTCCGCC
TCCATCATGGCTGCCTTCATGGACAACCCTTTCGAGTTCAACCCCGAGGACCCCATCCCTGACACTAACA
GCACATCTGGAGACCCGGTGGAGAAGAAGGACGAAACACCTTTTGGGGTCTCGGTGGCTGTGGGCCT
GGCCGTCTTTGCCTGCCTCTTCCTTTCTACGCTGCTCCTTGTGCTCAACAAATGTGGACGGAGAAACAAG
TTTGGGATCAACCGCCCGGCTGTGCTGGCTCCAGAGGATGGGCTGGCCATGTCCCTGCATTTCATGACA
TTGGGTGGCAGCTCCCTGTCCCCCACCGAGGGCAAAGGCTCTGGGCTCCAAGGCCACATCATCGAGAA
CCCACAATACTTCAGTGATGCCTGTGTTCACCACATCAAGCGCCGGGACATCGTGCTCAAGTGGGAGCT
GGGGGAGGGCGCCTTTGGGAAGGTCTTCCTTGCTGAGTGCCACAACCTCCTGCCTGAGCAGGACAAG
ATGCTGGTGGCTGTCAAGGCACTGAAGGAGGCGTCCGAGAGTGCTCGGCAGGACTTCCAGCGTGAGG
CTGAGCTGCTCACCATGCTGCAGCACCAGCACATCGTGCGCTTCTTCGGCGTCTGCACCGAGGGCCGCC
CCCTGCTCATGGTCTTTGAGTATATGCGGCACGGGGACCTCAACCGCTTCCTCCGATCCCATGGACCTGA
TGCCAAGCTGCTGGCTGGTGGGGAGGATGTGGCTCCAGGCCCCCTGGGTCTGGGGCAGCTGCTGGCC
GTGGCTAGCCAGGTCGCTGCGGGGATGGTGTACCTGGCGGGTCTGCATTTTGTGCACCGGGACCTGGC
CACACGCAACTGTCTAGTGGGCCAGGGACTGGTGGTCAAGATTGGTGATTTTGGCATGAGCAGGGATA
TCTACAGCACCGACTATTACCGTGTGGGAGGCCGCACCATGCTGCCCATTCGCTGGATGCCGCCCGAGA
GCATCCTGTACCGTAAGTTCACCACCGAGAGCGACGTGTGGAGCTTCGGCGTGGTGCTCTGGGAGATC
TTCACCTACGGCAAGCAGCCCTGGTACCAGCTCTCCAACACGGAGGCAATCGACTGCATCACGCAGGG
ACGTGAGTTGGAGCGGCCACGTGCCTGCCCACCAGAGGTCTACGCCATCATGCGGGGCTGCTGGCAGC
GGGAGCCCCAGCAACGCCACAGCATCAAGGATGTGCACGCCCGGCTGCAAGCCCTGGCCCAGGCACC
TCCTGTCTACCTGGATGTCCTGGGCTAG

FIG. 36B

MLRGGRRGQLGWHSWAAGPGSLLAWLILASAGAAPCPDACCPHGSSGLRCTRDGALDSLHHLPGAENLT
ELYIENQQHLQHLELRDLRGLGELRNLTIVKSGLRFVAPDAFHFTPRLSRLNLSFNALESLSWKTVQGLSLQEL
VLSGNPLHCSCALRWLQRWEEEGLGGVPEQKLQCHGQGPLAHMPNASCGVPTLKVQVPNASVDVGDD
VLLRCQVEGRGLEQAGWILTELEQSATVMKSGGLPSLGLTLANVTSDLNRKNVTCWAENDVGRAEVSVQV
NVSFPASVQLHTAVEMHHWCIPFSVDGQPAPSLRWLFNGSVLNETSFIFTEFLEPAANETVRHGCLRLNQP
THVNNGNYTLLAANPFGQASASIMAAFMDNPFEFNPEDPIPVSFSPVDTNSTSGDPVEKKDETPFGVSVA
VGLAVFACLFLSTLLLVLNKCGRRNKFGINRPAVLAPEDGLAMSLHFMTLGGSSLSPTEGKGSGLQGHIIENP
QYFSDACVHHIKRRDIVLKWELGEGAFGKVFLAECHNLLPEQDKMLVAVKALKEASESARQDFQREAELLT
MLQHQHIVRFFGVCTEGRPLLMVFEYMRHGDLNRFLRSHGPDAKLLAGGEDVAPGPLGLGQLLAVASQV
AAGMVYLAGLHFVHRDLATRNCLVGQGLVVKIGDFGMSRDIYSTDYYRVGGRTMLPIRWMPPESILYRKFT
TESDVWSFGVVLWEIFTYGKQPWYQLSNTEAIDCITQGRELERPRACPPEVYAIMRGCWQREPQQRHSIK
DVHARLQALAQAPPVYLDVLG

FIG. 36C

MKEAALICLAPSVPPILTVKSWDTMQLRAARSRCTNLLAASYIENQQHLQHLELRDLRGLGELRNLTIVKSGL
RFVAPDAFHFTPRLSRLNLSFNALESLSWKTVQGLSLQELVLSGNPLHCSCALRWLQRWEEEGLGGVPEQK
LQCHGQGPLAHMPNASCGVPTLKVQVPNASVDVGDDVLLRCQVEGRGLEQAGWILTELEQSATVMKSG
GLPSLGLTLANVTSDLNRKNVTCWAENDVGRAEVSVQVNVSFPASVQLHTAVEMHHWCIPFSVDGQPAPS
LRWLFNGSVLNETSFIFTEFLEPAANETVRHGCLRLNQPTHVNNGNYTLLAANPFGQASASIMAAFMDNP
FEFNPEDPIPDTNSTSGDPVEKKDETPFGVSVAVGLAVFACLFLSTLLLVLNKCGRRNKFGINRPAVLAPEDGL
AMSLHFMTLGGSSLSPTEGKGSGLQGHIIENPQYFSDACVHHIKRRDIVLKWELGEGAFGKVFLAECHNLLP
EQDKMLVAVKALKEASESARQDFQREAELLTMLQHQHIVRFFGVCTEGRPLLMVFEYMRHGDLNRFLRSH
GPDAKLLAGGEDVAPGPLGLGQLLAVASQVAAGMVYLAGLHFVHRDLATRNCLVGQGLVVKIGDFGMSR
DIYSTDYYRVGGRTMLPIRWMPPESILYRKFTTESDVWSFGVVLWEIFTYGKQPWYQLSNTEAIDCITQGRE
LERPRACPPEVYAIMRGCWQREPQQRHSIKDVHARLQALAQAPPVYLDVLG

FIG. 36D

ATGTCGTCCTGGATAAGGTGGCATGGACCCGCCATGGCGCGGCTCTGGGGCTTCTGCTGGCTGGTTGTG
GGCTTCTGGAGGGCCGCTTTCGCCTGTCCCACGTCCTGCAAATGCAGTGCCTCTCGGATCTGGTGCAGC
GACCCTTCTCCTGGCATCGTGGCATTTCCGAGATTGGAGCCTAACAGTGTAGATCCTGAGAACATCACCG
AAATTTTCATCGCAAACCAGAAAAGGTTAGAAATCATCAACGAAGATGATGTTGAAGCTTATGTGGGAC
TGAGAAATCTGACAATTGTGGATTCTGGATTAAAATTTGTGGCTCATAAAGCATTTCTGAAAAACAGCAA
CCTGCAGCACATCAATTTTACCCGAAACAAACTGACGAGTTTGTCTAGGAAACATTTCCGTCACCTTGAC
TTGTCTGAACTGATCCTGGTGGGCAATCCATTTACATGCTCCTGTGACATTATGTGGATCAAGACTCTCCA
AGAGGCTAAATCCAGTCCAGACACTCAGGATTTGTACTGCCTGAATGAAAGCAGCAAGAATATTCCCCT
GGCAAACCTGCAGATACCCAATTGTGGTTTGCCATCTGCAAATCTGGCCGCACCTAACCTCACTGTGGA
GGAAGGAAAGTCTATCACATTATCCTGTAGTGTGGCAGGTGATCCGGTTCCTAATATGTATTGGGATGTT
GGTAACCTGGTTTCCAAACATATGAATGAAACAAGCCACACACAGGGCTCCTTAAGGATAACTAACATTT
CATCCGATGACAGTGGGAAGCAGATCTCTTGTGTGGCGGAAAATCTTGTAGGAGAAGATCAAGATTCTG
TCAACCTCACTGTGCATTTTGCACCAACTATCACATTTCTCGAATCTCCAACCTCAGACCACCACTGGTGC
ATTCCATTCACTGTGAAAGGCAACCCCAAACCAGCGCTTCAGTGGTTCTATAACGGGGCAATATTGAATG
AGTCCAAATACATCTGTACTAAAATACATGTTACCAATCACACGGAGTACCACGGCTGCCTCCAGCTGGAT
AATCCCACTCACATGAACAATGGGGACTACACTCTAATAGCCAAGAATGAGTATGGGAAGGATGAGAAA
CAGATTTCTGCTCACTTCATGGGCTGGCCTGGAATTGACGATGGTGCAAACCCAAATTATCCTGATGTAA
TTTATGAAGATTATGGAACTGCAGCGAATGACATCGGGGACACCACGAACAGAAGTAATGAAATCCCTT
CCACAGACGTCACTGATAAAACCGGTCGGGAACATCTCTCGGTCTATGCTGTGGTGGTGATTGCGTCTGT
GGTGGGATTTTGCCTTTTGGTAATGCTGTTTCTGCTTAAGTTGGCAAGACACTCCAAGTTTGGCATGAA
AGATTTCTCATGGTTTGGATTTGGGAAAGTAAAATCAAGACAAGGTGTTGGCCCAGCCTCCGTTATCAG
CAATGATGATGACTCTGCCAGCCCACTCCATCACATCTCCAATGGGAGTAACACTCCATCTTCTTCGGAAG
GTGGCCCAGATGCTGTCATTATTGGAATGACCAAGATCCCTGTCATTGAAAATCCCCAGTACTTTGGCAT
CACCAACAGTCAGCTCAAGCCAGACACATTTGTTCAGCACATCAAGCGACATAACATTGTTCTGAAAAG
GGAGCTAGGCGAAGGAGCCTTTGGAAAAGTGTTCCTAGCTGAATGCTATAACCTCTGTCCTGAGCAGG
ACAAGATCTTGGTGGCAGTGAAGACCCTGAAGGATGCCAGTGACAATGCACGCAAGGACTTCCACCGT
GAGGCCGAGCTCCTGACCAACCTCCAGCATGAGCACATCGTCAAGTTCTATGGCGTCTGCGTGGAGGG
CGACCCCCTCATCATGGTCTTTGAGTACATGAAGCATGGGGACCTCAACAAGTTCCTCAGGGCACACGG
CCCTGATGCCGTGCTGATGGCTGAGGGCAACCCGCCCACGGAACTGACGCAGTCGCAGATGCTGCATAT
AGCCCAGCAGATCGCCGCGGGCATGGTCTACCTGGCGTCCCAGCACTTCGTGCACCGCGATTTGGCCAC
CAGGAACTGCCTGGTCGGGGAGAACTTGCTGGTGAAAATCGGGGACTTTGGGATGTCCCGGGACGTG
TACAGCACTGACTACTACAGGGTCGGTGGCCACACAATGCTGCCCATTCGCTGGATGCCTCCAGAGAGC
ATCATGTACAGGAAATTCACGACGGAAAGCGACGTCTGGAGCCTGGGGGTCGTGTTGTGGGAGATTTT
CACCTATGGCAAACAGCCCTGGTACCAGCTGTCAAACAATGAGGTGATAGAGTGTATCACTCAGGGCCG
AGTCCTGCAGCGACCCCGCACGTGCCCCCAGGAGGTGTATGAGCTGATGCTGGGGTGCTGGCAGCGA
GAGCCCCACATGAGGAAGAACATCAAGGGCATCCATACCCTCCTTCAGAACTTGGCCAAGGCATCTCCG
GTCTACCTGGACATTCTAGGCTAG

FIG. 37A

MSSWIRWHGPAMARLWGFCWLVVGFWRAAFACPTSCKCSASRIWCSDPSPGIVAFPRLEPNSVDPENIT
EIFIANQKRLEIINEDDVEAYVGLRNLTIVDSGLKFVAHKAFLKNSNLQHINFTRNKLTSLSRKHFRHLDLSELIL
VGNPFTCSCDIMWIKTLQEAKSSPDTQDLYCLNESSKNIPLANLQIPNCGLPSANLAAPNLTVEEGKSITLSCS
VAGDPVPNMYWDVGNLVSKHMNETSHTQGSLRITNISSDDSGKQISCVAENLVGEDQDSVNLTVHFAPTI
TFLESPTSDHHWCIPFTVKGNPKPALQWFYNGAILNESKYICTKIHVTNHTEYHGCLQLDNPTHMNNGDYT
LIAKNEYGKDEKQISAHFMGWPGIDDGANPNYPDVIYEDYGTAANDIGDTTNRSNEIPSTDVTDKTGREHL
SVYAVVVIASVVGFCLLVMLFLLKLARHSKFGMKDFSWFGFGKVKSRQGVGPASVISNDDDSASPLHHISNG
SNTPSSSEGGPDAVIIGMTKIPVIENPQYFGITNSQLKPDTFVQHIKRHNIVLKRELGEGAFGKVFLAECYNLC
PEQDKILVAVKTLKDASDNARKDFHREAELLTNLQHEHIVKFYGVCVEGDPLIMVFEYMKHGDLNKFLRAH
GPDAVLMAEGNPPTELTQSQMLHIAQQIAAGMVYLASQHFVHRDLATRNCLVGENLLVKIGDFGMSRDV
YSTDYYRVGGHTMLPIRWMPPESIMYRKFTTESDVWSLGVVLWEIFTYGKQPWYQLSNNEVIECITQGRVL
QRPRTCPQEVYELMLGCWQREPHMRKNIKGIHTLLQNLAKASPVYLDILG

FIG. 37B

1 ggaaaaacag attccgagcc gcaaaaggga agacggattc tcagacaagg cttgcaaatg
61 ccccgcagcc atcatttaac tgcacccgca gaatagttac ggtttgtcac ccgaccctcc
121 cggatcgcct aatttgtccc tagtgagacc ccgaggctct gcccgcgcct ggcttcttcg
181 tagctggatg catatcgtgc tccgggcagc gcgggcgcag ggcacgcgtt cgcgcacacc
241 ctagcacaca tgaacacgcg caagagctga accaagcacg gtttccattt caaaaaggga
301 gacagcctct accgcgattg tagaagagac tgtggtgtga attagggacc gggaggcgtc
361 gaacggagga acggttcatc ttagagacta attttctgga gtttctgccc ctgctctgcg
421 tcagccctca cgtcacttcg ccagcagtag cagaggcggc ggcggcggct cccggaattg
481 ggttggagca ggagcctcgc tggctgcttc gctcgcgctc tacgcgctca gtccccggcg
541 gtagcaggag cctggaccca ggcgccgccg gcgggcgtga ggcgccggag cccggcctcg
601 aggtgcatac cggacccccca ttcgcatcta acaaggaatc tgcgccccag agagtcccgg
661 gagcgccgcc ggtcggtgcc cggcgcgccg ggccatgcag cgacggccgc cgcggagctc
721 cgagcagcgg tagcgccccc ctgtaaagcg gttcgctatg ccggggccac tgtgaaccct
781 gccgcctgcc ggaacactct tcgctccgga ccagctcagc ctctgataag ctggactcgg
841 cacgcccgca acaagcaccg aggagttaag agagccgcaa gcgcagggaa ggcctccccg
901 cacgggtggg ggaaagcggc cggtgcagcg cggggacagg cactcgggct ggcactggct
961 gctaggg*atg* tcgtcctgga taaggtggca tggacccgcc atggcgcggc tctggggctt
1021 ctgctggctg gttgtgggct tctggagggc cgctttcgcc tgtcccacgt cctgcaaatg
1081 cagtgcctct cggatctggt gcagcgaccc ttctcctggc atcgtggcat ttccgagatt
1141 ggagcctaac agtgtagatc ctgagaacat caccgaaatt ttcatcgcaa accagaaaag
1201 gttagaaatc atcaacgaag atgatgttga agcttatgtg ggactgagaa atctgacaat
1261 tgtggattct ggattaaaat ttgtggctca taaagcattt ctgaaaaaca gcaacctgca
1321 gcacatcaat tttacccgaa acaaactgac gagtttgtct aggaaacatt tccgtcacct
1381 tgacttgtct gaactgatcc tggtgggcaa tccatttaca tgctcctgtg acattatgtg
1441 gatcaagact ctccaagagg ctaaatccag tccagacact caggatttgt actgcctgaa
1501 tgaaagcagc aagaatattc ccctggcaaa cctgcagata cccaattgtg gtttgccatc
1561 tgcaaatctg gccgcaccta acctcactgt ggaggaagga aagtctatca cattatcctg
1621 tagtgtggca ggtgatccgg ttcctaatat gtattgggat gttggtaacc tggtttccaa
1681 acatatgaat gaaacaagcc acacacaggg ctccttaagg ataactaaca tttcatccga
1741 tgacagtggg aagcagatct cttgtgtggc ggaaaatctt gtaggagaag atcaagattc
1801 tgtcaacctc actgtgcatt ttgcaccaac tatcacattt ctcgaatctc caacctcaga
1861 ccaccactgg tgcattccat tcactgtgaa aggcaacccc aaaccagcgc ttcagtggtt
1921 ctataacggg gcaatattga atgagtccaa atacatctgt actaaaatac atgttaccaa
1981 tcacacggag taccacggct gcctccagct ggataatccc actcacatga acaatgggga
2041 ctacactcta atagccaaga atgagtatgg gaaggatgag aaacagattt ctgctcactt
2101 catgggctgg cctggaattg acgatggtgc aaacccaaat tatcctgatg taatttatga
2161 agattatgga actgcagcga atgacatcgg ggacaccacg aacagaagta atgaaatccc
2221 ttccacagac gtcactgata aaaccggtcg ggaacatctc tcggtctatg ctgtggtggt
2281 gattgcgtct gtggtgggat tttgcctttt ggtaatgctg tttctgctta agttggcaag
2341 acactccaag tttggcatga aagatttctc atggtttgga tttgggaaag taaaatcaag
2401 acaaggtgtt ggcccagcct ccgttatcag caatgatgat gactctgcca gcccactcca
2461 tcacatctcc aatgggagta acactccatc ttcttcggaa ggtggcccag atgctgtcat

FIG. 37C 2521 tattggaatg accaagatcc ctgtcattga aaatccccag tactttggca tcaccaacag
2581 tcagctcaag ccagacacat ttgttcagca catcaagcga cataacattg ttctgaaaag
2641 ggagctaggc gaaggagcct ttggaaaagt gttcctagct gaatgctata acctctgtcc
2701 tgagcaggac aagatcttgg tggcagtgaa gaccctgaag gatgccagtg acaatgcacg
2761 caaggacttc caccgtgagg ccgagctcct gaccaacctc cagcatgagc acatcgtcaa
2821 gttctatggc gtctgcgtgg agggcgaccc cctcatcatg gtctttgagt acatgaagca
2881 tggggacctc aacaagttcc tcagggcaca cggccctgat gccgtgctga tggctgaggg
2941 caacccgccc acggaactga cgcagtcgca gatgctgcat atagcccagc agatcgccgc
3001 gggcatggtc tacctggcgt cccagcactt cgtgcaccgc gatttggcca ccaggaactg
3061 cctggtcggg gagaacttgc tggtgaaaat cggggacttt gggatgtccc gggacgtgta
3121 cagcactgac tactacaggg tcggtggcca cacaatgctg cccattcgct ggatgcctcc
3181 agagagcatc atgtacagga aattcacgac ggaaagcgac gtctggagcc tgggggtcgt
3241 gttgtgggag attttcacct atggcaaaca gccctggtac cagctgtcaa acaatgaggt
3301 gatagagtgt atcactcagg gccgagtcct gcagcgaccc cgcacgtgcc cccaggaggt
3361 gtatgagctg atgctggggt gctggcagcg agagccccac atgaggaaga acatcaaggg
3421 catccatacc ctccttcaga acttggccaa ggcatctccg gtctacctgg acattctagg
3481 c*tag*ggccct tttccccaga ccgatccttc ccaacgtact cctcagacgg gctgagagga
3541 tgaacatctt ttaactgccg ctggaggcca ccaagctgct ctccttcact ctgacagtat
3601 taacatcaaa gactccgaga agctctcgag ggaagcagtg tgtacttctt catccataga
3661 cacagtattg acttcttttt ggcattatct ctttctctct ttccatctcc cttggttgtt
3721 cctttttctt tttttaaatt ttctttttct ttttttttc gtcttccctg cttcacgatt
3781 cttacccttt cttttgaatc aatctggctt ctgcattact attaactctg catagacaaa
3841 ggccttaaca aacgtaattt gttatatcag cagacactcc agtttgccca ccacaactaa
3901 caatgccttg ttgtattcct gcctttgatg tggatgaaaa aaagggaaaa caaatatttc
3961 acttaaactt tgtcacttct gctgtacaga tatcgagagt ttctatggat tcacttctat
4021 ttatttatta ttattactgt tcttattgtt tttggatggc ttaagcctgt gtataaaaaa
4081 gaaaacttgt gttcaatctg tgaagccttt atctatggga gattaaaacc agagagaaag
4141 aagatttatt atgaaccgca atatgggagg aacaaagaca accactggga tcagctggtg
4201 tcagtcccta cttaggaaat actcagcaac tgttagctgg gaagaatgta ttcggcacct
4261 tcccctgagg acctttctga ggagtaaaaa gactactggc ctctgtgcca tggatgattc
4321 ttttcccatc accagaaatg atagcgtgca gtagagagca aagatggctt ccgtgagaca
4381 caagatggcg catagtgtgc tcggacacag ttttgtcttc gtaggttgtg atgatagcac
4441 tggtttgttt ctcaagcgct atccacagaa cctttgtcaa cttcagttga aaagaggtgg
4501 attcatgtcc agagctcatt tcggggtcag gtgggaaagc caagaacttg gaaaagataa
4561 gacaagctat aaattcggag gcaagtttct tttacaatga acttttcaga tctcacttcc
4621 ctccgacccc taacttccat gcccacccgt ccttttaact gtgcaagcaa aattgtgcat
4681 ggtcttcgtc gattaatacc ttgtgtgcag acactactgc tccagacgtc gtttccctga
4741 taggtagagc agatccataa aaaggtatga cttatacaat taggggaagc taatggagtt
4801 tattagctga gtatcaatgt ctctgcgttg tacggtggtg atgggtttta atgaatatgg
4861 accctgaagc ctggaaatcc tcatccacgt cgaacccaca ggactgtggg aagggcagaa
4921 tcaatcccta agggaaagga aacctcaccc tgagggcatc acatgcactc atgttcagtg
4981 tacacaggtc aagtcccttg ctctgggctc tagttgggag agtggtttca ttccaagtgt FIG. 37C (continued)

5041 actccattgt cagtatgctg tttttgtttc cttcactcca ttcaaaaagt caaaatacaa
5101 aatttggcac agcatgccaa cgggaggctg tgcccagacc aagcactgga agtgtgcttc
5161 taggcatagt cattggtttt gcaaaaagag ggctcaaatt taaatagaaa tttacagcta
5221 tttgaatggt cagatatacc aagaaagaaa aatatttctg ttcctcaaga aaacttgcta
5281 ccctctgtga ggggaatttt gctaaacttg acatctttat aacatgagcc agattgaaag
5341 ggagtgattt tcattcatct taggtcatgt tatttcatat ttgtttctga aggtgcgata
5401 gctctgtttt aggttttgct tgcgcctgtt aattactgga acaccttatt tttcattaaa
5461 ggctttgaaa gccaattctc aaaaattcaa aagtgcaaat taacagaaca aaaggaaatc
5521 cagtagcaac tgcagtcaag cgagggagtt gacaagataa accttacgtc cattcaagtt
5581 atatgctggc ctatgagaga tgagagttgg gtcgtttgtt ctctttgttg atgattttaa
5641 aaaaaccctc tagaatacac ataataacat aatgaaagcc atatctccat gatatatatg
5701 tgcacatata tatacataca tgtgcatgta tgtatcatat taaggaccca tggtactctt
5761 aaaacactgt agaactctgt gacgcagtaa ggaaggggca gatttgtaca aaaacttttc
5821 tagattccat cagcaaaaac caacacaggt ttgtcacgct gcatgtctgg ccagctaatc
5881 tcgggggaaa agctacaagt tatttatttt attttaagag aataaagtag gtaataattt
5941 aagggatcaa attcaaggag gaatgtgcaa ttttagagca aagatttgtt taaggcaaat
6001 gagactttgg gagcatccca ttccagtttt gtcttttttt tctctgaaag aaaaaagcaa
6061 aaaataaaat aaaattccac ttataccttc tgacaagtcc ctaaaggtct tgaaataaaa
6121 ggttctatgc aagtgcaaag ttttatagtt atttttattg ctgattatta ctattactat
6181 ctctgttgtc ttaagagtat gtgctgattt cagagacatc tcaaattgaa agaatatcag
6241 attgctttta aagtagctga acgagccaca gaatatctga aattattcat tgttgttcct
6301 ccaccacccc ctttctcatg gtctgatttt tagaagagtg gcatcctcgt tctaaaatgt
6361 aatgatcacc aaatacggcc ttccatcaaa tttgtgaaaa ctacaacagt ataacagtga
6421 caaacctaat tctctagccc aaacctggtc tgacaatcat ttccatttag aagtcattga
6481 atagttttcc aaacactttc catgtgtgtt agcaaattat tcctattttg tgtagatgag
6541 gacgttgaga ctcagagaca ttcagaggca cgctagaggt ctccagccta gcttccagca
6601 ccattgggac tgaatccaag tactctcact ctgaacttcg tggttctgtc cactagagac
6661 tctaatatgc aaacaagcag ttcaggaaag aaagcatgct aacacattca tgaagcagta
6721 tatgaagtta gaagaacaaa aggaaataca ggagatgaca agcaactgag atattgtgat
6781 atataatcat gctcttagct tcagctaaat tcagctaaat tcttgtacac tgaaccaatg
6841 tcataatcag gcttatttag aaaacacttt gaactatgct ataaaagatt atatcagaat
6901 tcatattata catgtgttca catcagcgct acctgtgatg ttttcatgta tttatgtatg
6961 tgttataaat acttgattta tacatataca aatgcacata cgtagtgtgt ttgtgtgttt
7021 atgtataaat ttataggcac acaataatag aggtaattat aagtaggatg cggtatgaat
7081 aatttgctta aaatatgcta aataaccaaa actgtttaac gtcatgttgc tgttagtgct
7141 tccatactcc acgtgggtag gactacatca cacttttcaa ctctgtgcag tactgcatgg
7201 gtggaagaca tatttaagat aatgtgcttc ccaaaacaac tgaataaaag ccatcccact
7261 acattgagtg ctttctctgg ctccttgcaa agaaagatac tttttgtaat ggtccaggaa
7321 aggaacattg ctttcttttt gtctttcagc acatttgtat tatgctcacc ttgtctctgt
7381 ctcactgtga ccccctttaca cttgagttca gagttcaagc attccaaata taaattggaa
7441 tgttggcagc ccagtggctt gaaggccaat gatgagcagt ccaagacccc acagcgagat FIG. 37C (continued)

7501 gagcaactct taggaattcc cacatcctag agtgaatgca ccaactaaca gtatagaatg
7561 ctgtcctttt caaagcgtcc taacagcagg attacctggt caagtatgga ctttctttga
7621 atctttcttt tcacaaattg gactgcctgt aataccaata acattgttgt atctaactaa
7681 ataaatgact gcatatacac acataccctc aattctcttg cttccccatt ttctttttca
7741 tcccctgtct caggactttt attttcaatg ttgacctttg gtttggccat atatcactgt
7801 tataggaaat ctcatgagag gaatggctag tgacccaact ctccaaatgt ctaagttagt
7861 agttacagct gattttttat gatgcataat tggaatgtgg agcctctgag gttgtgatag
7921 cttgtacatg aatttcaaat gtcattctaa agaatgaggg gtgggaggga tttatagtta
7981 gaaacgacag tgcaggaagg ggtattttct tgttgtcagg gctggaatga atcactgctg
8041 ctcaagtcaa aggttcttga atatccttag tttttgcatt tcccctcctt ttcctttgac
8101 ctttatttat ttaattatgt atttatttat ttatttatat acttttgctc cattcagcac
8161 aaacacaaag caaagcaaaa aaaaaaatat atatatatat atctgtatat gtgttgtagg
8221 caaaacactg tgaatttcac aacaaccacc accaagcaac tattttgcca tcttaacata
8281 catctcagga gacgaaatga gaaaagatgg ggatgtcatt ttttagtcta tgcgtttgag
8341 gccaggtcca tgtttattta tttctttagt ctatgcatta atgaaaatga tcctgagtgg
8401 aggttagctg aacgttcaat gtactggagc aagcatcata aaagctgcta gtagccatgt
8461 gtttgaacag gaaaaatatt acagaaaatg aaatgtaaag gcctatatct tgcagcttgt
8521 atatcttact attgcttaaa aaatgtataa agcagctgga aatgttttaa atacaaggtc
8581 tttgaattaa atgtggattt taaatatgta atcccttgac aaatgaccaa attatggtga
8641 actattgctc cctgcgttct ttgatcatta cctatgactt acaaatctgc ctggagatgt
8701 ggacattctg catttgcttc tgtatctgga gagatgtttg tatatatcca ggccgtatac
8761 acacacattt ccatatctct ctacagatat atttcccctt caatcgtgac ctggtatttg
8821 gaactctcct tttcatttgg cttatcttcc ttttaatgtg atgtctctgt gctaatactt
8881 accagttctt gttttgcaat ctgttttgag gtccattgct ttactaagac ccactgcatc
8941 ttggctgatt tcaaagtgac acctgaatac agtgtttaaa aaaaaaaaag ttttgtttgt
9001 aaatcatgtg accagcttct ctcaacctga catggaaagt ctcttgtact acagtgtatt
9061 taataaaaat gatgtcttac aataaataac atactccaaa a FIG. 37C (continued)

ATGGATGTCTCTCTTTGCCCAGCCAAGTGTAGTTTCTGGCGGATTTTCTTGCTGGGAAGCGTCTGGCTG
GACTATGTGGGCTCCGTGCTGGCTTGCCCTGCAAATTGTGTCTGCAGCAAGACTGAGATCAATTGCCGG
CGGCCGGACGATGGGAACCTCTTCCCCCTCCTGGAAGGGCAGGATTCAGGGAACAGCAATGGGAACG
CCAGTATCAACATCACGGACATCTCAAGGAATATCACTTCCATACACATAGAGAACTGGCGCAGTCTTCA
CACGCTCAACGCCGTGGACATGGAGCTCTACACCGGACTTCAAAAGCTGACCATCAAGAACTCAGGAC
TTCGGAGCATTCAGCCCAGAGCCTTTGCCAAGAACCCCCATTTGCGTTATATAAACCTGTCAAGTAACCG
GCTCACCACACTCTCGTGGCAGCTCTTCCAGACGCTGAGTCTTCGGGAATTGCAGTTGGAGCAGAACTT
TTTCAACTGCAGCTGTGACATCCGCTGGATGCAGCTCTGGCAGGAGCAGGGGGAGGCCAAGCTCAAC
AGCCAGAACCTCTACTGCATCAACGCTGATGGCTCCCAGCTTCCTCTCTTCCGCATGAACATCAGTCAGT
GTGACCTTCCTGAGATCAGCGTGAGCCACGTCAACCTGACCGTACGAGAGGGTGACAACGCTGTTATCA
CTTGCAATGGCTCTGGATCACCCCTTCCTGATGTGGACTGGATAGTCACTGGGCTGCAGTCCATCAACAC
TCACCAGACCAATCTGAACTGGACCAATGTTCATGCCATCAACTTGACGCTGGTGAATGTGACGAGTGA
GGACAATGGCTTCACCCTGACGTGCATTGCAGAGAACGTGGTGGGCATGAGCAATGCCAGTGTTGCCC
TCACTGTCTACTATCCCCCACGTGTGGTGAGCCTGGAGGAGCCTGAGCTGCGCCTGGAGCACTGCATCG
AGTTTGTGGTGCGTGGCAACCCCCCACCAACGCTGCACTGGCTGCACAATGGGCAGCCTCTGCGGGAG
TCCAAGATCATCCATGTGGAATACTACCAAGAGGGAGAGATTTCCGAGGGCTGCCTGCTCTTCAACAAG
CCCACCCACTACAACAATGGCAACTATACCCTCATTGCCAAAAACCCACTGGGCACAGCCAACCAGACC
ATCAATGGCCACTTCCTCAAGGAGCCCTTTCCAGAGAGCACGGATAACTTTATCTTGTTTGACGAAGTG
AGTCCCACACCTCCTATCACTGTGACCCACAAACCAGAAGAAGACACTTTTGGGGTATCCATAGCAGTT
GGACTTGCTGCTTTTGCCTGTGTCCTGTTGGTGGTTCTCTTCGTCATGATCAACAAATATGGTCGACGGT
CCAAATTTGGAATGAAGGGTCCCGTGGCTGTCATCAGTGGTGAGGAGGACTCAGCCAGCCCACTGCAC
CACATCAACCACGGCATCACCACGCCCTCGTCACTGGATGCCGGGCCCGACACTGTGGTCATTGGCATG
ACTCGCATCCCTGTCATTGAGAACCCCCAGTACTTCCGTCAGGGACACAACTGCCACAAGCCGGACACG
TATGTGCAGCACATTAAGAGGAGAGACATCGTGCTGAAGCGAGAACTGGGTGAGGGAGCCTTTGGAA
AGGTCTTCCTGGCCGAGTGCTACAACCTCAGCCCGACCAAGGACAAGATGCTTGTGGCTGTGAAGGCC
CTGAAGGATCCCACCCTGGCTGCCCGGAAGGATTTCCAGAGGGAGGCCGAGCTGCTCACCAACCTGCA
GCATGAGCACATTGTCAAGTTCTATGGAGTGTGCGGCGATGGGGACCCCCTCATCATGGTCTTTGAATAC
ATGAAGCATGGAGACCTGAATAAGTTCCTCAGGGCCCATGGGCCAGATGCAATGATCCTTGTGGATGGA
CAGCCACGCCAGGCCAAGGGTGAGCTGGGGCTCTCCCAAATGCTCCACATTGCCAGTCAGATCGCCTC
GGGTATGGTGTACCTGGCCTCCCAGCACTTTGTGCACCGAGACCTGGCCACCAGGAACTGCCTGGTTG
GAGCGAATCTGCTAGTGAAGATTGGGGACTTCGGCATGTCCAGAGATGTCTACAGCACGGATTATTACA
GGGTGGGAGGACACACCATGCTCCCCATTCGCTGGATGCCTCCTGAAAGCATCATGTACCGGAAGTTCA
CTACAGAGAGTGATGTATGGAGCTTCGGGGTGATCCTCTGGGAGATCTTCACCTATGGAAAGCAGCCAT
GGTTCCAACTCTCAAACACGGAGGTCATTGAGTGCATTACCCAAGGTCGTGTTTTGGAGCGGCCCCGA
GTCTGCCCCAAAGAGGTGTACGATGTCATGCTGGGGTGCTGGCAGAGGGAACCACAGCAGCGGTTGA
ACATCAAGGAGATCTACAAAATCCTCCATGCTTTGGGGAAGGCCACCCCAATCTACCTGGACATTCTTGG
CTAG

FIG. 38A

MDVSLCPAKCSFWRIFLLGSVWLDYVGSVLACPANCVCSKTEINCRRPDDGNLFPLLEGQDSGNSNGNASI
NITDISRNITSIHIENWRSLHTLNAVDMELYTGLQKLTIKNSGLRSIQPRAFAKNPHLRYINLSSNRLTTLSWQL
FQTLSLRELQLEQNFFNCSCDIRWMQLWQEQGEAKLNSQNLYCINADGSQLPLFRMNISQCDLPEISVSHV
NLTVREGDNAVITCNGSGSPLPDVDWIVTGLQSINTHQTNLNWTNVHAINLTLVNVTSEDNGFTLTCIAEN
VVGMSNASVALTVYYPPRVVSLEEPELRLEHCIEFVVRGNPPPTLHWLHNGQPLRESKIIHVEYYQEGEISEG
CLLFNKPTHYNNGNYTLIAKNPLGTANQTINGHFLKEPFPESTDNFILFDEVSPTPPITVTHKPEEDTFGVSIA
VGLAAFACVLLVVLFVMINKYGRRSKFGMKGPVAVISGEEDSASPLHHINHGITTPSSLDAGPDTVVIGMTRI
PVIENPQYFRQGHNCHKPDTYVQHIKRRDIVLKRELGEGAFGKVFLAECYNLSPTKDKMLVAVKALKDPTLA
ARKDFQREAELLTNLQHEHIVKFYGVCGDGDPLIMVFEYMKHGDLNKFLRAHGPDAMILVDGQPRQAKG
ELGLSQMLHIASQIASGMVYLASQHFVHRDLATRNCLVGANLLVKIGDFGMSRDVYSTDYYRVGGHTMLPI
RWMPPESIMYRKFTTESDVWSFGVILWEIFTYGKQPWFQLSNTEVIECITQGRVLERPRVCPKEVYDVMLG
CWQREPQQRLNIKEIYKILHALGKATPIYLDILG

FIG. 38B

NTRK FUSION MOLECULES AND USES THEREOF

CROSS-REFERENCE TO RELATED APPLICATION

This application is a U.S. National Stage Application under 35 U.S.C. § 371 of International Application No. PCT/US2020/034421, filed May 22, 2020, which claims the benefit of U.S. Provisional Application 62/852,583, filed May 24, 2019, each of which is hereby incorporated by reference in its entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 197102002900SEQLIST.TXT, date recorded: Nov. 23, 2021, size: 1,106,742 bytes).

FIELD

Provided herein are methods related to detecting NTRK1, NTRK2, or NTRK3 gene fusions, as well as methods of diagnosis/treatment, uses, and kits related thereto.

BACKGROUND

Cancer represents the phenotypic end-point of multiple genetic lesions that endow cells with a full range of biological properties required for tumorigenesis. Indeed, a hallmark genomic feature of many cancers, including, for example, ovarian cancer, B cell cancer, lung cancer, breast cancer, pancreatic cancer, and colon cancer, is the presence of numerous complex chromosome structural aberrations, including translocations, intra-chromosomal inversions, point mutations, deletions, gene copy number changes, gene expression level changes, and germline mutations, among others.

The neurotrophic receptor tyrosine kinase (NTRK) genes NTRK1, NTRK2, and NTRK3 encode tropomyosin receptor kinase (TRK) proteins A, B, and C, respectively, and are expressed during normal neuronal development (Amatu et al (2016) ESMO Open, 1(2):e000023). The receptor tyrosine kinases encoded by NTRK1, NTRK2, and NTRK3 are known to regulate cell proliferation, differentiation, and survival of neurons by activating several downstream pathways that also play a role in tumorigenesis (e.g., GRB2-RAS-MAPK and RAS-PI3K-AKT1).

NTRK gene fusions that include an N-terminal oligomerization-promoting partner gene linked to the kinase domain have been characterized as activating, exhibiting constitutive kinase activity and tyrosine phosphorylation. NTRK gene fusions have emerged as targets for cancer therapy (Vaishnavi et al (2015) Cancer Discov, 5:25i34; Cocco et al (2018) Nat Rev Clin Oncol, 15:731-747). For example, larotrectinib is a potent and highly selective TRK inhibitor (Cocco et al (2018) Nat Rev Clin Oncol, 15:731-747), and the first agent to receive tumor-agnostic (histology independent) approval by the U.S. Food and Drug Administration (FDA) and European Medicines Agency for the treatment of patients with locally advanced or metastatic solid tumors carrying NTRK gene fusions (Bayer HealthCare Pharmaceuticals Inc., VITRAKVI Prescribing Information, 2019; European Medicines Agency, EPAR 2019, available at the website https://www[dot]ema[dot]europa[dot]eu/en/medicines/human/EPAR/vitrakvi). Entrectinib, a multikinase inhibitor, has also been approved by the FDA for adult and pediatric patients ≥12 years of age with locally advanced or metastatic NTRK fusion-positive solid tumors (Roche, ROZLYTREK Prescribing Information, 2019). Larotrectinib has demonstrated durable antitumor efficacy in a combined analysis of three phase I/II trials in adults and/or children irrespective of patient age or tumor type (Drilon et al (2018) N Engl J Med, 378:731-739). The efficacy was sustained after further follow-up and in an expanded patient population (n=159), the overall response rate was 79% and the median duration of response was 35.2 (22.7—not evaluable [NE]) months (Hyman et al (2019) Ann Oncol, 30(supplement 5):244.007). These studies show the importance of NTRK gene fusions as actionable drug targets.

Accordingly, there is a need in the art for identifying novel genetic lesions, e.g., novel NTRK gene fusions, associated with cancer. Such genetic lesions can be an effective approach to develop compositions, methods and assays for evaluating and treating cancer patients.

BRIEF SUMMARY

The disclosure is based, at least in part, on the discovery of novel rearrangement events that give rise to fusion molecules that include a fragment of a first gene and a fragment of a second gene, e.g., a fusion that includes a 5'-exon and a 3'-exon summarized in FIGS. 1A-1C. The term "fusion" or "fusion molecule" is used generically herein, and includes any fusion molecule (e.g., gene, gene product (e.g., cDNA, mRNA, or polypeptide), and variant thereof) that includes a fragment of a first gene or gene product and a fragment of a second gene or gene product described herein, including, e.g., (i) all or part of MEX3A (Mex-3 RNA binding family member A) and all or part of NTRK1 (Neurotrophic tyrosine kinase receptor type 1), referred to herein as "MEX3A-NTRK1 fusion molecules"; or (ii) all or part of CARM1 (Coactivator associated arginine methyltransferase 1) and all or part of NTRK3 (Neurotrophic tyrosine kinase receptor type 3), referred to herein as "CARM1-NTRK3 fusion molecules," as summarized in FIGS. 1A-1C. Expression of the fusion molecules was detected in cancer tissues, thus suggesting an association with neoplastic growth or cancer (including pre-malignant, or malignant and/or metastatic growth).

Accordingly, the disclosure provides, at least in part, the following: methods for identifying, assessing, or detecting a fusion molecule as described herein; methods for identifying, assessing, evaluating, and/or treating a cancer, e.g., a cancer associated with a fusion molecule as described herein, in vitro, ex vivo, or in vivo; methods for identifying, assessing, evaluating, and/or treating a subject having a cancer, e.g., a cancer having a fusion molecule as described herein; fusion nucleic acid molecules, nucleic acid constructs, host cells containing the nucleic acid molecules; fusion polypeptides and binding agents; detection reagents (e.g., baits, probes, primers, antibodies, kits, capable, e.g., of specific detection of a fusion molecule); screening assays for identifying molecules that interact with, e.g., inhibit, the fusions, e.g., novel kinase inhibitors; as well as assays and kits for evaluating, identifying, assessing and/or treating a subject having a cancer, e.g., a cancer having a fusion molecule as described herein. The compositions and methods disclosed herein can be used, for example, to identify new inhibitors; to evaluate, identify, or select a subject, e.g., a patient, having a cancer; and to treat or prevent a cancer.

Accordingly, in one aspect, the disclosure features an isolated MEX3A-NTRK1 fusion nucleic acid molecule comprising a nucleotide sequence chosen from:

(i) a nucleotide sequence comprising exon 1 of SEQ ID NO: 1 (MEX3A) and one or more, or all, of exons 9-17 of SEQ ID NO: 3 (NTRK1), or a nucleotide sequence at least 70%, 75%, 80%, 85%, 90%, 91%, 92%, 93%, 94% 95%, 96%, 97%, 98%, 99%, or 99.5% identical thereto;

(ii) a nucleotide sequence comprising the nucleotide sequence of SEQ ID NO: 5, or a nucleotide sequence at least 70%, 75%, 80%, 85%, 90%, 91%, 92%, 93%, 94% 95%, 96%, 97%, 98%, 99%, or 99.5% identical thereto;

(iii) a nucleotide sequence encoding the amino acid sequence of SEQ ID NO: 6, or a nucleotide sequence at least 70%, 75%, 80%, 85%, 90%, 91%, 92%, 93%, 94% 95%, 96%, 97%, 98%, 99%, or 99.5% identical thereto;

(iv) a nucleotide sequence comprising all or a portion of the MEX3A-NTRK1 fusion nucleic acid molecule Breakpoint 1 and/or Breakpoint 2 depicted in FIG. 1A; or (v) a fragment of any of (i)-(iv) comprising a nucleotide sequence from a MEX3A gene and a nucleotide sequence from an NTRK1 gene.

In another aspect, the disclosure features a nucleic acid molecule that is capable of hybridizing to the nucleic acid molecule described herein.

In another aspect, the disclosure features a fragment of a nucleic acid molecule described herein, in which the fragment comprises between 10 and 25 nucleotides, or between 100 and 300 nucleotides.

In certain embodiments, the fragment comprises a probe or primer that comprises between about 5 and 25 nucleotides. In other embodiments, the fragment is a bait that comprises between about 100 and 300 nucleotides, 130 and 230 nucleotides, or 150 and 200 nucleotides.

In another aspect, the disclosure features a nucleic acid molecule suitable as a probe, primer, bait, or library member, that specifically binds to a nucleic acid molecule described herein, or a fragment described herein.

In certain embodiments, the nucleic acid molecule or the fragment is operatively linked to a native or a heterologous regulatory nucleotide sequence.

In another aspect, the disclosure features a vector comprising a nucleic acid molecule described herein, or a fragment described herein.

In another aspect, the disclosure features a host cell comprising a vector described herein.

In another aspect, the disclosure features a nucleic acid molecule that specifically reduces or inhibits the expression, or alters a function, of a nucleic acid molecule described herein.

In certain embodiments, the nucleic acid molecule is chosen from an antisense molecule, a ribozyme, an siRNA, a guide RNA (gRNA), or a triple helix molecule.

In another aspect, the disclosure features an isolated MEX3A-NTRK1 fusion polypeptide comprising an amino acid sequence chosen from:

(i) the amino acid sequence encoded by exon 1 of SEQ ID NO: 1 (MEX3A) and encoded by one or more, or all, of exons 9-17 of SEQ ID NO: 3 (NTRK1), or an amino acid sequence at least 70%, 75%, 80%, 85%, 90%, 91%, 92%, 93%, 94% 95%, 96%, 97%, 98%, 99%, or 99.5% identical thereto;

(ii) the amino acid sequence encoded by the nucleotide sequence of SEQ ID NO: 5, or an amino acid sequence at least 70%, 75%, 80%, 85%, 90%, 91%, 92%, 93%, 94% 95%, 96%, 97%, 98%, 99%, or 99.5% identical thereto;

(iii) the amino acid sequence of SEQ ID NO: 6, or an amino acid sequence at least 70%, 75%, 80%, 85%, 90%, 91%, 92%, 93%, 94% 95%, 96%, 97%, 98%, 99%, or 99.5% identical thereto;

(iv) the amino acid sequence encoded by a nucleotide sequence comprising all or a portion of a MEX3A-NTRK1 fusion nucleic acid molecule Breakpoint 1 and/or Breakpoint 2 depicted in FIG. 1A; or (v) a fragment of any of (i)-(iv) comprising an amino acid sequence from a MEX3A polypeptide and an amino acid sequence from an NTRK1 polypeptide.

In certain embodiments the polypeptide has a TRKA kinase activity, and/or a dimerizing or multimerizing activity.

In another aspect, the disclosure features an isolated antibody molecule that specifically binds to a polypeptide described herein.

In another aspect, the disclosure features a reaction mixture comprising: a detection reagent capable of detecting a rearrangement associated with a MEX3A gene and/or an NTRK1 gene; and a target nucleic acid derived from a cancer, e.g., an ovarian cancer, e.g., an ovarian carcinosarcoma, wherein the target nucleic acid comprises a nucleic acid molecule described herein.

In some embodiments, the detection reagent detects the nucleotide sequence of a MEX3A-NTRK1 fusion nucleic acid molecule. In certain embodiments, the detection reagent distinguishes the nucleotide sequence of a MEX3A-NTRK1 fusion nucleic acid molecule, from a wildtype MEX3A or NTRK1 nucleotide sequence, or the nucleotide sequence of a second MEX3A or NTRK1 fusion nucleic acid molecule. In certain embodiments, the detection reagent comprises a DNA, RNA, or mixed DNA/RNA molecule comprising a nucleotide sequence that is complementary to a MEX3A-NTRK1 fusion nucleic acid molecule. In certain embodiments, the detection reagent detects the fusion junction of a MEX3A-NTRK1 fusion nucleic acid molecule.

In another aspect, the disclosure features a method of making a reaction mixture comprising: combining a detection reagent capable of detecting a rearrangement associated with a MEX3A gene and/or an NTRK1 gene with a target nucleic acid derived from a cancer, e.g., an ovarian cancer, e.g., an ovarian carcinosarcoma, wherein the target nucleic acid comprises a nucleic acid molecule described herein.

In another aspect, the disclosure features a preparation of a nucleic acid molecule described herein, or a fragment described herein, disposed in a sequencing device, or a sample holder for use in such a device.

In another aspect, the disclosure features a preparation of a nucleic acid molecule described herein, or a fragment described herein, disposed in a device for determining a physical or chemical property (e.g., stability of a duplex, e.g., $T_m$), or a sample holder for use in such a device.

In another aspect, the disclosure features a detection reagent comprising a DNA, RNA, or mixed DNA/RNA molecule, comprising a nucleotide sequence that is complementary to the nucleotide sequence of a MEX3A-NTRK1 fusion nucleic acid molecule.

In another aspect, the disclosure features a kit comprising a detection reagent described herein and instructions for use of the detection reagent to detect a MEX3A-NTRK1 fusion nucleic acid molecule.

In another aspect, the disclosure features a reaction mixture, comprising: a detection reagent capable of detecting a structural or functional property of a MEX3A-NTRK1 fusion polypeptide, e.g., a substrate, e.g., a substrate for phosphorylation, or an antibody; and a target protein derived from a cancer, e.g., an ovarian cancer, e.g., an ovarian carcinosarcoma, wherein the target protein comprises a polypeptide described herein.

In another aspect, the disclosure features a method of making a reaction mixture, comprising: combining a detection reagent capable of detecting a structural or functional property of a MEX3A-NTRK1 fusion polypeptide, e.g., a substrate, e.g., a substrate for phosphorylation, or an antibody; with a target protein derived from a cancer, e.g., an ovarian cancer, e.g., an ovarian carcinosarcoma, wherein the target protein comprises a polypeptide described herein.

In another aspect, the disclosure features a kit comprising an antibody molecule described herein and instructions for use of the antibody molecule to detect a MEX3A-NTRK1 fusion polypeptide.

In another aspect, the disclosure features a method of reducing an activity or expression of a MEX3A-NTRK1 fusion polypeptide described herein, comprising: optionally, acquiring knowledge of the presence of the MEX3A-NTRK1 fusion polypeptide; and contacting the MEX3A-NTRK1 fusion polypeptide, or a cell expressing the MEX3A-NTRK1 fusion polypeptide, with an agent that reduces an activity or expression of the MEX3A-NTRK1 fusion polypeptide.

In some embodiments, the contacting step is effected in vitro. In other embodiments, the contacting step is effected in vivo. In certain embodiments, the contacting step is effected in a human or animal subject.

In another aspect, the disclosure features an anti-cancer agent for use in treating a cancer in a subject, wherein the use comprises acquiring knowledge of the presence of a MEX3A-NTRK1 fusion nucleic acid molecule described herein or a MEX3A-NTRK1 fusion polypeptide described herein in the subject.

In some embodiments, the anti-cancer agent comprises: (i) a kinase inhibitor, e.g., an NTRK inhibitor, e.g., an NTRK1 inhibitor; and/or (ii) a methyl transferase inhibitor, e.g., a CARM1 inhibitor. In certain embodiments, the kinase inhibitor is administered responsive to a determination of presence of the MEX3A-NTRK1 fusion nucleic acid molecule or MEX3A-NTRK1 fusion polypeptide in a sample from the subject. In certain embodiments, the use is responsive to acquiring knowledge or information of the presence of the MEX3A-NTRK1 fusion nucleic acid molecule or MEX3A-NTRK1 fusion polypeptide in the subject. In certain embodiments, the use is responsive to acquiring knowledge or information of the presence of the MEX3A-NTRK1 fusion nucleic acid molecule or MEX3A-NTRK1 fusion polypeptide in the subject from another party. In certain embodiments, the use comprises receiving a communication of the presence of the MEX3A-NTRK1 fusion nucleic acid molecule or MEX3A-NTRK1 fusion polypeptide in the subject. In certain embodiments, the use is responsive to an identification of the presence of the MEX3A-NTRK1 fusion nucleic acid molecule or MEX3A-NTRK1 fusion polypeptide in the subject, wherein the identification arises from collaboration with another party.

In some embodiments, the use comprises determining the presence of the MEX3A-NTRK1 fusion nucleic acid molecule or MEX3A-NTRK1 fusion polypeptide by sequencing, e.g., next-generation sequencing (NGS).

In some embodiments, the cancer is a solid tumor. In some embodiments, the cancer is chosen from an ovarian cancer, a salivary gland mammary analogue secretory carcinoma, a soft tissue fibrosarcoma, a salivary gland tumor, histiocytosis, a thyroid tumor, a soft tissue sarcoma, or a chondrosarcoma. In certain embodiments, the cancer is ovarian cancer. In certain embodiments, the ovarian cancer is an ovarian carcinosarcoma. In certain embodiments, the cancer has no detectable altered level or activity in one or more of EGFR, KRAS, ALK, ROS1 or RET.

In some embodiments, the anti-cancer agent comprises a kinase inhibitor that selectively inhibits a kinase activity of the MEX3A-NTRK1 fusion polypeptide. In certain embodiments, the anti-cancer agent comprises a kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928. In certain embodiments, the anti-cancer agent comprises a kinase inhibitor chosen from an antisense molecule, a ribozyme, an siRNA, a triple helix-forming oligonucleotide, or a gRNA, each of which hybridizes to a MEX3A-NTRK1 fusion nucleic acid molecule, or a transcription regulatory region thereof.

In some embodiments, the anti-cancer agent is used in combination with a second therapeutic agent or modality. In certain embodiments, the second therapeutic agent comprises an HSP90 inhibitor. In certain embodiments, the HSP90 inhibitor comprises a benzoquinone or hygroquinone ansamycin HSP90 inhibitor. In certain embodiments, the HSP90 inhibitor comprises one or more of 17-AAG (also known as tanespimycin or CNF-1010), 17-DMAG, AT-13387, AUY-922 (also known as VER-49009), BIIB-021 (CNF-2024), BIIB-028, CCT-018159, CCT-129397, CNF-1010, CU-0305, Geldanamycin, IPI-504, Macbecin I, Macbecin II, MPC-3100, PF-04928473 (SNX-2112), Pochonin, PU-H71, Radanamycin, Radicol, SanA, di-SanA, SNX-5422, STA-9090, or XL-888.

In another aspect, the disclosure features a method for screening for an agent that inhibits the expression or activity of a MEX3A-NTRK1 fusion polypeptide described herein, comprising: optionally, determining if the MEX3A-NTRK1 fusion polypeptide, or a nucleic acid molecule encoding the MEX3A-NTRK1 fusion polypeptide, is present; contacting the MEX3A-NTRK1 fusion polypeptide, or a host cell expressing the MEX3A-NTRK1 fusion polypeptide, with a candidate agent; and detecting a change in a parameter associated with the MEX3A-NTRK1 fusion polypeptide.

In some embodiments, the parameter is the expression or an activity of the MEX3A-NTRK1 fusion polypeptide. In certain embodiments, the method further comprises comparing a value for the parameter to a reference value. In certain embodiments, the method further comprises comparing a parameter obtained from contacting a sample with the candidate agent to the same parameter obtained from not contacting a sample with the candidate agent. In certain embodiments, the method further comprises, if a decrease in the expression or activity of the MEX3A-NTRK1 fusion polypeptide is detected, identifying or classifying the candidate agent as an inhibitor.

In some embodiments, the contacting occurs in a cell-free system. In other embodiments, the contacting is effected in vitro, ex vivo, or in vivo.

In certain embodiments, the parameter is chosen from one or more of:

(i) direct binding of the candidate agent to the MEX3A-NTRK1 fusion polypeptide;

(ii) a change in an NTRK1 kinase activity;

(iii) a change in an activity of a cell containing the MEX3A-NTRK1 fusion polypeptide, e.g., a change in proliferation, morphology or tumorigenicity of the cell;

(iv) a change in a tumor present in an animal subject, e.g., size, appearance, proliferation, of the tumor; or (v) a change in the level of the MEX3A-NTRK1 fusion polypeptide or a nucleic acid molecule encoding the MEX3A-NTRK1 fusion polypeptide.

In another aspect, the disclosure features a method of determining the presence of a MEX3A-NTRK1 fusion nucleic acid molecule or a MEX3A-NTRK1 fusion polypeptide, comprising: directly acquiring knowledge that a MEX3A-NTRK1 fusion nucleic acid molecule described herein, or a MEX3A-NTRK1 fusion polypeptide described herein, is present in a sample.

In some embodiments, the sample comprises fluid (e.g., blood or serum), cells, or tissue (e.g., a tumor tissue). In certain embodiments, the sample is a nucleic acid sample, e.g., a sample comprising cell-free DNA (cfDNA) or circulating tumor DNA (ctDNA). In other embodiments, the sample is a protein sample.

In some embodiments, the sample is acquired from a subject (e.g., a human subject). In certain embodiments, the sample comprises a tumor biopsy, a circulating tumor cell, or a circulating tumor nucleic acid. In certain embodiments, the sample is from a cancer that has no detectable altered level or activity in one or more of EGFR, KRAS, ALK, ROS1 or RET.

In some embodiments, the sample is from a subject having an ovarian cancer. In certain embodiments, the ovarian cancer is an ovarian carcinosarcoma.

In some embodiments, the MEX3A-NTRK1 fusion nucleic acid molecule is detected. In certain embodiments, the MEX3A-NTRK1 fusion nucleic acid molecule is detected by a method chosen from one or more of: a nucleic acid hybridization assay, an amplification-based assay, a PCR-RFLP assay, real-time PCR, sequencing, a screening analysis, FISH, spectral karyotyping or MFISH, comparative genomic hybridization, in situ hybridization, sequence-specific priming (SSP) PCR, HPLC, or mass-spectrometric genotyping.

In some embodiments, the method comprises acquiring a read for a nucleotide position in the MEX3A-NTRK1 fusion nucleic acid molecule by sequencing, thereby detecting that the MEX3A-NTRK1 fusion nucleic acid molecule is present.

In some embodiments, the read acquired is compared to a reference nucleotide sequence, optionally a wildtype MEX3A reference nucleotide sequence or a wildtype NTRK1 reference nucleotide sequence. In certain embodiments, the MEX3A-NTRK1 fusion polypeptide is detected.

In some embodiments, the method comprises: contacting a sample with a reagent which specifically binds to the MEX3A-NTRK1 fusion polypeptide; and detecting the formation of a complex of the MEX3A-NTRK1 fusion polypeptide and the reagent. In certain embodiments, the reagent is labeled with a detectable moiety to facilitate detection of the bound and unbound reagent. In certain embodiments, the reagent is an antibody molecule.

In another aspect, the disclosure features a method of evaluating a subject, comprising: identifying, selecting, or obtaining information or knowledge that the subject has participated in a clinical trial or has been treated for a cancer; and acquiring genotype information that identifies a MEX3A-NTRK1 fusion nucleic acid molecule or MEX3A-NTRK1 polypeptide in the subject, wherein the presence of the MEX3A-NTRK1 fusion nucleic acid molecule or MEX3A-NTRK1 fusion polypeptide identifies the subject as having an increased risk for, or having, a cancer associated with the MEX3A-NTRK1 fusion nucleic acid molecule or the MEX3A-NTRK1 fusion polypeptide.

In some embodiments, the method further comprises providing a report to a party. In certain embodiments, the party is the subject, a caregiver, a physician, an oncologist, a hospital, a clinic, a third-party payor, an insurance company or a government office. In certain embodiments, the report is in electronic, web-based, or paper form. In certain embodiments, the report identifies the presence or absence of the MEX3A-NTRK1 fusion nucleic acid molecule or the MEX3A-NTRK1 fusion polypeptide, and optionally comprises an identifier for the subject from which the MEX3A-NTRK1 fusion nucleic acid molecule or the MEX3A-NTRK1 fusion polypeptide was obtained.

In certain embodiments, the report comprises: information on the role of the MEX3A-NTRK1 fusion nucleic acid molecule or MEX3A-NTRK1 fusion polypeptide, in disease;

information on prognosis, resistance, or potential or suggested therapeutic options; information on the likely effectiveness of a therapeutic option, the acceptability of a therapeutic option, or the advisability of applying the therapeutic option to a subject; or information, or a recommendation on, the administration of a drug.

In another aspect, the disclosure features a method for generating a personalized cancer treatment report, comprising:

obtaining a sample from a subject, detecting a MEX3A-NTRK1 fusion nucleic acid molecule or a MEX3A-NTRK1 fusion polypeptide in the sample;

selecting a treatment based on the MEX3A-NTRK1 fusion nucleic acid molecule or the MEX3A-NTRK1 fusion polypeptide detected; and providing a report comprising information on the MEX3A-NTRK1 fusion nucleic acid molecule or the MEX3A-NTRK1 fusion polypeptide detected and the treatment selected.

In another aspect, the disclosure features an isolated CARM1-NTRK3 fusion nucleic acid molecule comprising a nucleotide sequence chosen from:

(i) a nucleotide sequence comprising one or more, or all, of exons 1-3 of SEQ ID NO: 7 (CARM1) and one or more, or all, of exons 3-19 of SEQ ID NO: 9 (NTRK3), or a nucleotide sequence at least 70%, 75%, 80%, 85%, 90%, 91%, 92%, 93%, 94% 95%, 96%, 97%, 98%, 99%, or 99.5% identical thereto;

(ii) a nucleotide sequence comprising the nucleotide sequence of SEQ ID NO: 11, or a nucleotide sequence at least 70%, 75%, 80%, 85%, 90%, 91%, 92%, 93%, 94% 95%, 96%, 97%, 98%, 99%, or 99.5% identical thereto;

(iii) a nucleotide sequence encoding the amino acid sequence of SEQ ID NO: 12, or a nucleotide sequence at least 70%, 75%, 80%, 85%, 90%, 91%, 92%, 93%, 94% 95%, 96%, 97%, 98%, 99%, or 99.5% identical thereto;

(iv) a nucleotide sequence comprising all or a portion of the CARM1-NTRK3 fusion nucleic acid molecule Breakpoint 1 and/or Breakpoint 2 depicted in FIG. 1A; or (v) a fragment of any of (i)-(iv) comprising a nucleotide sequence from a CARM1 gene and a nucleotide sequence from an NTRK3 gene.

In another aspect, the disclosure features a nucleic acid molecule that is capable of hybridizing to the nucleic acid molecule described herein.

In another aspect, the disclosure features a fragment of a nucleic acid molecule described herein, in which the fragment comprises between 10 and 25 nucleotides, or between 100 and 300 nucleotides.

In certain embodiments, the fragment comprises a probe or primer that comprises between about 5 and 25 nucleotides. In other embodiments, the fragment is a bait that comprises between about 100 and 300 nucleotides, 130 and 230 nucleotides, or 150 and 200 nucleotides.

In another aspect, the disclosure features a nucleic acid molecule suitable as a probe, primer, bait, or library member that specifically binds to a nucleic acid molecule described herein, or a fragment described herein.

In certain embodiments, the nucleic acid molecule or the fragment is operatively linked to a native or a heterologous regulatory nucleotide sequence.

In another aspect, the disclosure features a vector comprising a nucleic acid molecule described herein, or a fragment described herein.

In another aspect, the disclosure features a host cell comprising a vector described herein.

In another aspect, the disclosure features a nucleic acid molecule that specifically reduces or inhibits the expression, or alters a function, of a nucleic acid molecule described herein.

In certain embodiments, the nucleic acid molecule is chosen from an antisense molecule, a ribozyme, an siRNA, a guide RNA (gRNA), or a triple helix molecule.

In another aspect, the disclosure features an isolated CARM1-NTRK3 fusion polypeptide comprising an amino acid sequence chosen from:

(i) the amino acid sequence encoded by exons 1-3 of SEQ ID NO: 7 (CARM1) and encoded by one or more, or all, of exons 3-19 of SEQ ID NO: 9 (NTRK3), or an amino acid sequence at least 70%, 75%, 80%, 85%, 90%, 91%, 92%, 93%, 94% 95%, 96%, 97%, 98%, 99%, or 99.5% identical thereto;

(ii) the amino acid sequence encoded by the nucleotide sequence of SEQ ID NO: 11, or an amino acid sequence at least 70%, 75%, 80%, 85%, 90%, 91%, 92%, 93%, 94% 95%, 96%, 97%, 98%, 99%, or 99.5% identical thereto;

(iii) the amino acid sequence of SEQ ID NO: 12, or an amino acid sequence at least 70%, 75%, 80%, 85%, 90%, 91%, 92%, 93%, 94% 95%, 96%, 97%, 98%, 99%, or 99.5% identical thereto;

(iv) the amino acid sequence encoded by a nucleotide sequence comprising all or a portion of a CARM1-NTRK3 fusion nucleic acid molecule Breakpoint 1 and/or Breakpoint 2 depicted in FIG. 1A; or (v) a fragment of any of (i)-(iv) comprising an amino acid sequence from a CARM1 polypeptide and an amino acid sequence from an NTRK3 polypeptide.

In certain embodiments the polypeptide has a TRKA kinase activity, and/or a dimerizing or multimerizing activity.

In another aspect, the disclosure features an isolated antibody molecule that specifically binds to a polypeptide described herein.

In another aspect, the disclosure features a reaction mixture comprising:

a detection reagent capable of detecting a rearrangement associated with a CARM1 gene and/or an NTRK3 gene; and a target nucleic acid derived from a cancer, e.g., a melanoma, e.g., a vaginal melanoma, wherein the target nucleic acid comprises a nucleic acid molecule described herein.

In some embodiments, the detection reagent detects the nucleotide sequence of a CARM1-NTRK3 fusion nucleic acid molecule. In certain embodiments, the detection reagent distinguishes the nucleotide sequence of a CARM1-NTRK3 fusion nucleic acid molecule, from a wildtype CARM1 or NTRK3 nucleotide sequence, or the nucleotide sequence of a second CARM1 fusion nucleic acid molecule or NTRK3 fusion nucleic acid molecule. In certain embodiments, the detection reagent comprises a DNA, RNA, or mixed DNA/RNA molecule comprising a nucleotide sequence that is complementary to a CARM1-NTRK3 fusion nucleic acid molecule. In certain embodiments, the detection reagent detects the fusion junction of a CARM1-NTRK3 fusion nucleic acid molecule.

In another aspect, the disclosure features a method of making a reaction mixture comprising:

combining a detection reagent capable of detecting a rearrangement associated with a CARM1 gene and/or an NTRK3 gene with a target nucleic acid derived from a cancer, e.g., a melanoma, e.g., a vaginal melanoma, wherein the target nucleic acid comprises a nucleic acid molecule described herein.

In another aspect, the disclosure features a preparation of a nucleic acid molecule described herein, or a fragment described herein, disposed in a sequencing device, or a sample holder for use in such a device.

In another aspect, the disclosure features a preparation of a nucleic acid molecule described herein, or a fragment described herein, disposed in a device for determining a physical or chemical property (e.g., stability of a duplex, e.g., $T_m$), or a sample holder for use in such a device.

In another aspect, the disclosure features a detection reagent comprising a DNA, RNA, or mixed DNA/RNA molecule, comprising a nucleotide sequence that is complementary to the nucleotide sequence of a MEX3A-NTRK1 fusion nucleic acid molecule.

In another aspect, the disclosure features a kit comprising a detection reagent described herein and instructions for use of the detection reagent to detect a CARM1-NTRK3 fusion nucleic acid molecule.

In another aspect, the disclosure features a reaction mixture, comprising:

a detection reagent capable of detecting a structural or functional property of a CARM1-NTRK3 fusion polypeptide, e.g., a substrate, e.g., a substrate for phosphorylation, or an antibody; and a target protein derived from a cancer, e.g., a melanoma, e.g., a vaginal melanoma, wherein the target protein comprises a polypeptide described herein.

In another aspect, the disclosure features a method of making a reaction mixture, comprising:

combining a detection reagent capable of detecting a structural or functional property of a CARM1-NTRK3 fusion polypeptide, e.g., a substrate, e.g., a substrate for phosphorylation, or an antibody; with a target protein derived from a cancer, e.g., a melanoma, e.g., a vaginal melanoma, wherein the target protein comprises a polypeptide described herein.

In another aspect, the disclosure features a kit comprising an antibody molecule described herein and instructions for use of the antibody molecule to detect a CARM1-NTRK3 fusion polypeptide.

In another aspect, the disclosure features a method of reducing an activity or expression of a CARM1-NTRK3 fusion polypeptide described herein, comprising:

optionally, acquiring knowledge of the presence of the CARM1-NTRK3 fusion polypeptide; and contacting the CARM1-NTRK3 fusion polypeptide, or a cell expressing the CARM1-NTRK3 fusion polypeptide, with an agent that reduces an activity or expression of the CARM1-NTRK3 fusion polypeptide.

In some embodiments, the contacting step is effected in vitro. In other embodiments, the contacting step is effected in vivo. In certain embodiments, the contacting step is effected in a human or animal subject.

In another aspect, the disclosure features an anti-cancer agent for use in treating a cancer in a subject, wherein the use comprises acquiring knowledge of the presence of a CARM1-NTRK3 fusion nucleic acid molecule described herein or a CARM1-NTRK3 fusion polypeptide described herein.

In some embodiments, the anti-cancer agent comprises a kinase inhibitor, e.g., an NTRK inhibitor, e.g., an NTRK3 inhibitor. In certain embodiments, the kinase inhibitor is administered responsive to a determination of presence of the CARM1-NTRK3 fusion nucleic acid molecule or CARM1-NTRK3 fusion polypeptide in a sample from the subject. In certain embodiments, the use is responsive to acquiring knowledge or information of the presence of the CARM1-NTRK3 fusion nucleic acid molecule or CARM1-NTRK3 fusion polypeptide in the subject. In certain embodiments, the use is responsive to acquiring knowledge or information of the presence of the CARM1-NTRK3 fusion nucleic acid molecule or CARM1-NTRK3 fusion polypeptide in the subject from another party. In certain embodiments, the use comprises receiving a communication of the presence of the CARM1-NTRK3 fusion nucleic acid molecule or CARM1-NTRK3 fusion polypeptide in the subject. In certain embodiments, the use is responsive to an identification of the presence of the CARM1-NTRK3 fusion nucleic acid molecule or CARM1-NTRK3 fusion polypeptide in the subject, wherein the identification arises from collaboration with another party.

In some embodiments, the use comprises determining the presence of the CARM1-NTRK3 fusion nucleic acid molecule or CARM1-NTRK3 fusion polypeptide by sequencing, e.g., next-generation sequencing (NGS).

In some embodiments, the cancer is chosen from a melanoma, a salivary gland mammary analogue secretory carcinoma, a soft tissue fibrosarcoma, a salivary gland tumor, histiocytosis, a thyroid tumor, a soft tissue sarcoma, or a chondrosarcoma. In certain embodiments, the cancer is melanoma. In certain embodiments, the melanoma is a vaginal melanoma. In certain embodiments, the cancer has no detectable altered level or activity in one or more of EGFR, KRAS, ALK, ROS1 or RET. In some embodiments, the cancer is a solid tumor.

In some embodiments, the anti-cancer agent comprises a kinase inhibitor that selectively inhibits a kinase activity of the CARM1-NTRK3 fusion polypeptide. In certain embodiments, the anti-cancer agent comprises a kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928. In certain embodiments, the anti-cancer agent comprises a kinase inhibitor chosen from an antisense molecule, a ribozyme, an siRNA, a triple helix-forming oligonucleotide, or a gRNA, each of which hybridizes to a CARM1-NTRK3 fusion nucleic acid molecule, or a transcription regulatory region thereof.

In some embodiments the anti-cancer agent comprises a methyl transferase inhibitor that selectively inhibits a methyl transferase activity of the CARM1-NTRK3 fusion polypeptide. In certain embodiments, the anti-cancer agent comprises a methyl transferase chosen from one or more of: EZM 2302 (EZM2302 or GSK 3359088); a PRMT4/CARM1 Inhibitor (e.g., 3,5-bis[(3-bromo-4-hydroxyphenyl)methylene]-1-(phenylmethyl)-4-piperidinone); or EPZ025654.

In another aspect, the disclosure features a method for screening for an agent that inhibits the expression or activity of a CARM1-NTRK3 fusion polypeptide described herein, comprising: optionally, determining if the CARM1-NTRK3 fusion polypeptide, or a nucleic acid molecule encoding the CARM1-NTRK3 fusion polypeptide, is present; contacting the CARM1-NTRK3 fusion polypeptide, or a host cell expressing the CARM1-NTRK3 fusion polypeptide, with a candidate agent; and detecting a change in a parameter associated with the CARM1-NTRK3 fusion polypeptide.

In some embodiments, the parameter is the expression or an activity of the CARM1-NTRK3 fusion polypeptide. In certain embodiments, the method further comprises comparing a value for the parameter to a reference value. In certain embodiments, the method further comprises comparing a parameter obtained from contacting a sample with the candidate agent to the same parameter obtained from not contacting a sample with the candidate agent. In certain embodiments, the method further comprises, if a decrease in the expression or activity of the CARM1-NTRK3 fusion polypeptide is detected, identifying or classifying the candidate agent as an inhibitor.

In some embodiments, the contacting occurs in a cell-free system. In other embodiments, the contacting is effected in vitro, ex vivo, or in vivo.

In certain embodiments, the parameter is chosen from one or more of:

(i) direct binding of the candidate agent to the CARM1-NTRK3 fusion polypeptide;

(ii) a change in an NTRK3 kinase activity;

(iii) a change in an activity of a cell containing the CARM1-NTRK3 fusion polypeptide, e.g., a change in proliferation, morphology or tumorigenicity of the cell;

(iv) a change in a tumor present in an animal subject, e.g., size, appearance, proliferation, of the tumor; or (v) a change in the level of the CARM1-NTRK3 fusion polypeptide or a nucleic acid molecule encoding the CARM1-NTRK3 fusion polypeptide.

In another aspect, the disclosure features a method of determining the presence of a CARM1-NTRK3 fusion nucleic acid molecule or a CARM1-NTRK3 fusion polypeptide, comprising: directly acquiring knowledge that a CARM1-NTRK3 fusion nucleic acid molecule described herein, or a CARM1-NTRK3 fusion polypeptide described herein, is present in a sample.

In some embodiments, the sample comprises fluid (e.g., blood or serum), cells, or tissue (e.g., a tumor tissue). In certain embodiments, the sample is a nucleic acid sample, e.g., a sample comprising cell-free DNA (cfDNA) or circulating tumor DNA (ctDNA). In other embodiments, the sample is a protein sample.

In some embodiments, the sample is acquired from a subject (e.g., a human subject). In certain embodiments, the sample comprises a tumor biopsy, a circulating tumor cell, or a circulating tumor nucleic acid. In certain embodiments, the sample is from a cancer that has no detectable altered level or activity in one or more of EGFR, KRAS, ALK, ROS1 or RET.

In some embodiments, the sample is from a subject having a melanoma. In certain embodiments, the melanoma is a vaginal melanoma.

In some embodiments, the CARM1-NTRK3 fusion nucleic acid molecule is detected. In certain embodiments, the CARM1-NTRK3 fusion nucleic acid molecule is detected by a method chosen from one or more of: a nucleic acid hybridization assay, an amplification-based assay, a PCR-RFLP assay, real-time PCR, sequencing, a screening analysis, FISH, spectral karyotyping or MFISH, comparative genomic hybridization, in situ hybridization, sequence-specific priming (SSP) PCR, HPLC, or mass-spectrometric genotyping.

In some embodiments, the method comprises acquiring a read for a nucleotide position in the CARM1-NTRK3 fusion nucleic acid molecule by sequencing, thereby detecting that the CARM1-NTRK3 fusion nucleic acid molecule is present.

In some embodiments, the read acquired is compared to a reference nucleotide sequence, optionally a wildtype CARM1 reference nucleotide sequence or a wildtype NTRK3 reference nucleotide sequence. In certain embodiments, the CARM1-NTRK3 fusion polypeptide is detected.

In some embodiments, the method comprises: contacting the sample with a reagent which specifically binds to the CARM1-NTRK3 fusion polypeptide; and detecting the formation of a complex of the CARM1-NTRK3 fusion polypeptide and the reagent. In certain embodiments, the reagent is labeled with a detectable moiety to facilitate detection of the bound and unbound reagent. In certain embodiments, the reagent is an antibody molecule.

In another aspect, the disclosure features a method of evaluating a subject, comprising: identifying, selecting, or obtaining information or knowledge that the subject has participated in a clinical trial or has been treated for a cancer; and acquiring genotype information that identifies a CARM1-NTRK3 fusion nucleic acid molecule or CARM1-NTRK3 polypeptide in the subject, wherein the presence of the CARM1-NTRK3 fusion nucleic acid molecule or CARM1-NTRK3 fusion polypeptide identifies the subject as having an increased risk for, or having, a cancer associated with the CARM1-NTRK3 fusion nucleic acid molecule or the CARM1-NTRK3 fusion polypeptide.

In some embodiments, the method further comprises providing a report to a party. In certain embodiments, the party is the subject, a caregiver, a physician, an oncologist, a hospital, a clinic, a third-party payor, an insurance company or a government office. In certain embodiments, the report is in electronic, web-based, or paper form. In certain embodiments, the report identifies the presence or absence of the CARM1-NTRK3 fusion nucleic acid molecule or the CARM1-NTRK3 fusion polypeptide, and optionally comprises an identifier for the subject from which the CARM1-NTRK3 fusion nucleic acid molecule or the CARM1-NTRK3 fusion polypeptide was obtained.

In certain embodiments, the report comprises:

information on the role of the CARM1-NTRK3 fusion nucleic acid molecule or CARM1-NTRK3 fusion polypeptide, in disease;

information on prognosis, resistance, or potential or suggested therapeutic options;

information on the likely effectiveness of a therapeutic option, the acceptability of a therapeutic option, or the advisability of applying the therapeutic option to a subject; or information, or a recommendation on, the administration of a drug.

In another aspect, the disclosure features a method for generating a personalized cancer treatment report, comprising:

obtaining a sample from a subject, detecting a CARM1-NTRK3 fusion nucleic acid molecule or a CARM1-NTRK3 fusion polypeptide in the sample;

selecting a treatment based on the CARM1-NTRK3 fusion nucleic acid molecule or the CARM1-NTRK3 fusion polypeptide detected; and providing a report comprising information on the CARM1-NTRK3 fusion nucleic acid molecule or the CARM1-NTRK3 fusion polypeptide detected and the treatment selected.

In another aspect, provided herein is an isolated fusion nucleic acid molecule, wherein the isolated fusion nucleic acid is an NTRK1 fusion nucleic acid molecule comprising: (i) a nucleotide sequence comprising one or more exons of a nucleotide sequence of Table A or a nucleotide sequence at least 70%, 75%, 80%, 85%, 90%, 91%, 92%, 93%, 94% 95%, 96%, 97%, 98%, 99%, or 99.5% identical thereto, and one or more exons of the nucleotide sequence of any of SEQ ID NOs: 3, 186, or 187 (NTRK1) or a nucleotide sequence at least 70%, 75%, 80%, 85%, 90%, 91%, 92%, 93%, 94% 95%, 96%, 97%, 98%, 99%, or 99.5% identical thereto; (ii) a nucleotide sequence of Table C, or a nucleotide sequence at least 70%, 75%, 80%, 85%, 90%, 91%, 92%, 93%, 94% 95%, 96%, 97%, 98%, 99%, or 99.5% identical thereto; (iii) a nucleotide sequence encoding an amino acid sequence of Table D, or a nucleotide sequence at least 70%, 75%, 80%, 85%, 90%, 91%, 92%, 93%, 94% 95%, 96%, 97%, 98%, 99%, or 99.5% identical thereto; (iv)

a nucleotide sequence comprising all or a portion of an NTRK1 fusion nucleic acid molecule comprising Breakpoint 1 and/or Breakpoint 2 of Table E or a rearrangement of Table E; or (v)

a fragment of any of (i)-(iv) comprising a nucleotide sequence from a gene of Table A and a nucleotide sequence from an NTRK1 gene.

In another aspect, provided herein is a nucleic acid molecule that is capable of hybridizing to a nucleic acid molecule provided herein, comprising a nucleotide sequence that is complimentary to the nucleotide sequence of an NTRK1 fusion nucleic acid molecule comprising Breakpoint 1 and/or Breakpoint 2 of Table E or a rearrangement of Table E.

In another aspect, provided herein is an isolated fusion nucleic acid molecule, wherein the isolated fusion nucleic acid is an NTRK2 fusion nucleic acid molecule comprising: (i) a nucleotide sequence comprising one or more exons of a nucleotide sequence of Table F or a nucleotide sequence at least 70%, 75%, 80%, 85%, 90%, 91%, 92%, 93%, 94% 95%, 96%, 97%, 98%, 99%, or 99.5% identical thereto, and one or more exons of the nucleotide sequence of SEQ ID NO: 190 or SEQ ID NO: 194 (NTRK2) or a nucleotide sequence at least 70%, 75%, 80%, 85%, 90%, 91%, 92%, 93%, 94% 95%, 96%, 97%, 98%, 99%, or 99.5% identical thereto; (ii) a nucleotide sequence of Table H, or a nucleotide sequence at least 70%, 75%, 80%, 85%, 90%, 91%, 92%, 93%, 94% 95%, 96%, 97%, 98%, 99%, or 99.5% identical thereto; (iii) a nucleotide sequence encoding an amino acid sequence of Table I, or a nucleotide sequence at least 70%, 75%, 80%, 85%, 90%, 91%, 92%, 93%, 94% 95%, 96%, 97%, 98%, 99%, or 99.5% identical thereto; (iv) a nucleotide sequence comprising all or a portion of an NTRK2 fusion nucleic acid molecule comprising Breakpoint 1 and/or Breakpoint 2 of Table J or a rearrangement of Table J; or (v)

a fragment of any of (i)-(iv) comprising a nucleotide sequence from a gene of Table F and a nucleotide sequence from an NTRK2 gene.

In another aspect, provided herein is a nucleic acid molecule that is capable of hybridizing to a nucleic acid molecule provided herein, comprising a nucleotide sequence that is complimentary to the nucleotide sequence of an NTRK2 fusion nucleic acid molecule comprising Breakpoint 1 and/or Breakpoint 2 of Table J or a rearrangement of Table J.

In another aspect, provided herein is an isolated fusion nucleic acid molecule, wherein the isolated fusion nucleic acid is an NTRK3 fusion nucleic acid molecule comprising: (i) a nucleotide sequence comprising one or more exons of a nucleotide sequence of Table K or a nucleotide sequence at least 70%, 75%, 80%, 85%, 90%, 91%, 92%, 93%, 94% 95%, 96%, 97%, 98%, 99%, or 99.5% identical thereto, and one or more exons of the nucleotide sequence of any of SEQ ID NOs: 9 or 192 (NTRK3) or a nucleotide sequence at least 70%, 75%, 80%, 85%, 90%, 91%, 92%, 93%, 94% 95%, 96%, 97%, 98%, 99%, or 99.5% identical thereto; (ii) a nucleotide sequence of Table M, or a nucleotide sequence at least 70%, 75%, 80%, 85%, 90%, 91%, 92%, 93%, 94% 95%, 96%, 97%, 98%, 99%, or 99.5% identical thereto; (iii) a nucleotide sequence encoding an amino acid sequence of Table N, or a nucleotide sequence at least 70%, 75%, 80%, 85%, 90%, 91%, 92%, 93%, 94% 95%, 96%, 97%, 98%, 99%, or 99.5% identical thereto; (iv) a nucleotide sequence comprising all or a portion of an NTRK3 fusion nucleic acid molecule comprising Breakpoint 1 and/or Breakpoint 2 of Table O or a rearrangement of Table O; or (v) a fragment of any of (i)-(iv) comprising a nucleotide sequence from a gene of Table K and a nucleotide sequence from an NTRK3 gene.

In another aspect, provided herein is a nucleic acid molecule that is capable of hybridizing to a nucleic acid molecule provided herein, comprising a nucleotide sequence that is complimentary to the nucleotide sequence of an NTRK3 fusion nucleic acid molecule comprising Breakpoint 1 and/or Breakpoint 2 of Table O or a rearrangement of Table O.

In another aspect, provided herein is a fragment of a nucleic acid molecule provided herein, wherein said fragment comprises between 10 and 25 nucleotides, or between 100 and 300 nucleotides. In some embodiments, the fragment is a probe or a primer that comprises between about 5 and about 25 nucleotides. In some embodiments, the fragment is a bait that comprises between about 100 and about 300 nucleotides, between about 130 and about 230 nucleotides, or between about 150 and about 200 nucleotides. In some embodiments, the fragment is operatively linked to a native or a heterologous regulatory nucleotide sequence.

In another aspect, provided herein is a nucleic acid molecule suitable as a probe, primer, bait, or library member that specifically binds to a nucleic acid molecule provided herein. In some embodiments, the nucleic acid molecule is operatively linked to a native or a heterologous regulatory nucleotide sequence.

In another aspect, provided herein is a vector comprising a nucleic acid molecule provided herein.

In another aspect, provided herein is a host cell comprising a vector provided herein.

In another aspect, provided herein is a nucleic acid molecule that specifically reduces or inhibits the expression, or alters a function of a nucleic acid molecule provided herein. In some embodiments, the nucleic acid molecule is an antisense molecule, a ribozyme, an siRNA, a guide RNA (gRNA), or a triple helix molecule.

In another aspect, provided herein is an isolated fusion polypeptide, wherein the isolated fusion polypeptide is an NTRK1 fusion polypeptide comprising: (i) an amino acid sequence encoded by one or more exons of a nucleotide sequence of Table A or an amino acid sequence at least 70%, 75%, 80%, 85%, 90%, 91%, 92%, 93%, 94% 95%, 96%, 97%, 98%, 99%, or 99.5% identical thereto, and an amino acid sequence encoded by one or more exons of the nucleotide sequence of any of SEQ ID NOs: 3, 186, or 187 (NTRK1) or an amino acid sequence at least 70%, 75%, 80%, 85%, 90%, 91%, 92%, 93%, 94% 95%, 96%, 97%, 98%, 99%, or 99.5% identical thereto; (ii) an amino acid sequence encoded by a nucleotide sequence of Table C, or an amino acid sequence at least 70%, 75%, 80%, 85%, 90%, 91%, 92%, 93%, 94% 95%, 96%, 97%, 98%, 99%, or 99.5% identical thereto; (iii) an amino acid sequence of Table D, or an amino acid sequence at least 70%, 75%, 80%, 85%, 90%, 91%, 92%, 93%, 94% 95%, 96%, 97%, 98%, 99%, or 99.5% identical thereto; (iv) an amino acid sequence encoded by a nucleotide sequence comprising all or a portion of an NTRK1 fusion nucleic acid molecule comprising Breakpoint 1 and/or Breakpoint 2 of Table E or a rearrangement of Table E; or (v) a fragment of any of (i)-(iv) comprising an amino acid sequence of a polypeptide of Table B and an amino acid sequence of an NTRK1 polypeptide. In some embodiments, the polypeptide has a TRKA kinase activity, and/or a dimerizing or multimerizing activity.

In another aspect, provided herein is an isolated fusion polypeptide, wherein the isolated fusion polypeptide is an NTRK2 fusion polypeptide comprising: (i) an amino acid sequence encoded by one or more exons of a nucleotide sequence of Table F or an amino acid sequence at least 70%, 75%, 80%, 85%, 90%, 91%, 92%, 93%, 94% 95%, 96%, 97%, 98%, 99%, or 99.5% identical thereto, and an amino acid sequence encoded by one or more exons of the nucleotide sequence of SEQ ID NO: 190 or SEQ ID NO: 194 (NTRK2) or an amino acid sequence at least 70%, 75%, 80%, 85%, 90%, 91%, 92%, 93%, 94% 95%, 96%, 97%, 98%, 99%, or 99.5% identical thereto; (ii) an amino acid sequence encoded by a nucleotide sequence of Table H, or an amino acid sequence at least 70%, 75%, 80%, 85%, 90%, 91%, 92%, 93%, 94% 95%, 96%, 97%, 98%, 99%, or 99.5% identical thereto; (iii) an amino acid sequence of Table I, or an amino acid sequence at least 70%, 75%, 80%, 85%, 90%, 91%, 92%, 93%, 94% 95%, 96%, 97%, 98%, 99%, or 99.5% identical thereto; (iv) an amino acid sequence encoded by a nucleotide sequence comprising all or a portion of an NTRK2 fusion nucleic acid molecule comprising Breakpoint 1 and/or Breakpoint 2 of Table J or a rearrangement of Table J; or (v) a fragment of any of (i)-(iv) comprising an amino acid sequence of a polypeptide of Table G and an amino acid sequence of an NTRK2 polypeptide. In some embodiments, the polypeptide has a TRKB kinase activity, and/or a dimerizing or multimerizing activity.

In another aspect, provided herein is an isolated fusion polypeptide, wherein the isolated fusion polypeptide is an NTRK3 fusion polypeptide comprising: (i) an amino acid sequence encoded by one or more exons of a nucleotide sequence of Table K or an amino acid sequence at least 70%, 75%, 80%, 85%, 90%, 91%, 92%, 93%, 94% 95%, 96%, 97%, 98%, 99%, or 99.5% identical thereto, and an amino acid sequence encoded by one or more exons of the nucleotide sequence of any of SEQ ID NOs: 9 or 192 (NTRK3) or an amino acid sequence at least 70%, 75%, 80%, 85%, 90%, 91%, 92%, 93%, 94% 95%, 96%, 97%, 98%, 99%, or 99.5% identical thereto; (ii)

an amino acid sequence encoded by a nucleotide sequence of Table M, or an amino acid sequence at least 70%, 75%, 80%, 85%, 90%, 91%, 92%, 93%, 94% 95%, 96%, 97%, 98%, 99%, or 99.5% identical thereto; (iii) an amino acid sequence of Table N, or an amino acid sequence at least 70%, 75%, 80%, 85%, 90%, 91%, 92%, 93%, 94% 95%, 96%, 97%, 98%, 99%, or 99.5% identical thereto; (iv) an amino acid sequence encoded by a nucleotide sequence comprising all or a portion of an NTRK3 fusion nucleic acid molecule comprising Breakpoint 1 and/or Breakpoint 2 of Table O or a rearrangement of Table O; or (v) a fragment of any of (i)-(iv) comprising an amino acid sequence of a polypeptide of Table L and an amino acid sequence of an NTRK3 polypeptide. In some embodiments, the polypeptide has a TRKC kinase activity, and/or a dimerizing or multimerizing activity.

In another aspect, provided herein is an isolated antibody molecule that specifically binds to a polypeptide provided herein.

In another aspect, provided herein is a reaction mixture comprising a detection reagent capable of detecting a rearrangement associated with an NTRK1 gene and/or a gene of Table A, and a target nucleic acid derived from a cancer, wherein the target nucleic acid comprises a nucleic acid molecule of provided herein. In some embodiments, the detection reagent detects the nucleotide sequence of a nucleic acid molecule provided herein. In some embodiments, the detection reagent distinguishes the nucleotide sequence of a nucleic acid molecule provided herein from the nucleotide sequence of a wild-type NTRK1 gene and/or of a wild-type gene of Table A, or wherein the detection reagent distinguishes the nucleotide sequence of a nucleic acid molecule of provided herein from the nucleotide sequence of a second fusion nucleic acid molecule comprising all or a portion of the nucleotide sequence of an NTRK1 gene and/or all or a portion of the nucleotide sequence of a gene of Table A. In some embodiments, the detection reagent comprises a DNA, RNA, or mixed DNA/RNA molecule comprising a nucleotide sequence that is complementary to a nucleotide sequence of a nucleic acid molecule provided herein. In some embodiments, the detection reagent detects the fusion junction of a nucleic acid molecule provided herein.

In another aspect, provided herein is a method of making a reaction mixture comprising: combining a detection reagent capable of detecting a rearrangement associated with an NTRK1 gene and/or a gene of Table A with a target nucleic acid derived from a cancer, wherein the target nucleic acid comprises a nucleic acid molecule provided herein.

In another aspect, provided herein is a reaction mixture comprising a detection reagent capable of detecting a rearrangement associated with an NTRK2 gene and/or a gene of Table F, and a target nucleic acid derived from a cancer, wherein the target nucleic acid comprises a nucleic acid molecule provided herein. In some embodiments, the detection reagent detects the nucleotide sequence of a nucleic acid molecule provided herein. In some embodiments, the detection reagent distinguishes the nucleotide sequence of a nucleic acid molecule provided herein from the nucleotide sequence of a wild-type NTRK2 gene and/or of a wild-type gene of Table F, or wherein the detection reagent distinguishes the nucleotide sequence of a nucleic acid molecule provided herein from the nucleotide sequence of a second fusion nucleic acid molecule comprising all or a portion of the nucleotide sequence of an NTRK2 gene and/or all or a portion of the nucleotide sequence of a gene of Table F. In some embodiments, the detection reagent comprises a DNA, RNA, or mixed DNA/RNA molecule comprising a nucleotide sequence that is complementary to a nucleotide sequence of a nucleic acid molecule provided herein. In some embodiments, the detection reagent detects the fusion junction of a nucleic acid molecule provided herein.

In another aspect, provided herein is a method of making a reaction mixture comprising: combining a detection reagent capable of detecting a rearrangement associated with an NTRK2 gene and/or a gene of Table F with a target nucleic acid derived from a cancer, wherein the target nucleic acid comprises a nucleic acid molecule provided herein.

In another aspect, provided herein is a reaction mixture comprising a detection reagent capable of detecting a rearrangement associated with an NTRK3 gene and/or a gene of Table K, and a target nucleic acid derived from a cancer, wherein the target nucleic acid comprises a nucleic acid molecule provided herein. In some embodiments, the detection reagent detects a nucleotide sequence of the nucleic acid molecule provided herein. In some embodiments, the detection reagent distinguishes the nucleotide sequence of a nucleic acid molecule provided herein from the nucleotide sequence of a wild-type NTRK3 gene and/or of a wild-type gene of Table K, or wherein the detection reagent distinguishes the nucleotide sequence of a nucleic acid molecule provided herein from the nucleotide sequence of a second fusion nucleic acid molecule comprising all or a portion of the nucleotide sequence of an NTRK3 gene and/or all or a portion of the nucleotide sequence of a gene of Table K. In some embodiments, the detection reagent comprises a DNA, RNA, or mixed DNA/RNA molecule comprising a nucleotide sequence that is complementary to a nucleotide sequence of a nucleic acid molecule provided herein. In some embodiments, the detection reagent detects the fusion junction of a nucleic acid molecule provided herein.

In another aspect, provided herein is a method of making a reaction mixture comprising: combining a detection reagent capable of detecting a rearrangement associated with an NTRK3 gene and/or a gene of Table K with a target nucleic acid derived from a cancer, wherein the target nucleic acid comprises a nucleic acid molecule provided herein.

In another aspect, provided herein is a preparation of a nucleic acid molecule provided herein, disposed in a sequencing device, or a sample holder for use in such a device.

In another aspect, provided herein is a preparation of a nucleic acid molecule provided herein, disposed in a device for determining a physical or chemical property (e.g., stability of a duplex, e.g., $T_m$), or a sample holder for use in such a device.

In another aspect, provided herein is a detection reagent comprising a DNA, RNA, or mixed DNA/RNA molecule, comprising a nucleotide sequence that is complementary to the nucleotide sequence of a nucleic acid molecule provided herein.

In another aspect, provided herein is a kit comprising a detection reagent provided herein and instructions for use of the detection reagent to detect a nucleic acid molecule provided herein.

In another aspect, provided herein is a reaction mixture, comprising a detection reagent capable of detecting a structural or functional property of a fusion polypeptide provided herein, e.g., a substrate, e.g., a substrate for phosphorylation, or an antibody; and a target protein derived from a cancer, wherein the target protein comprises a polypeptide provided herein.

In another aspect, provided herein is a method of making a reaction mixture, comprising: combining a detection reagent capable of detecting a structural or functional property of a fusion polypeptide provided herein, e.g., a substrate, e.g., a substrate for phosphorylation, or an antibody, with a target protein derived from a cancer, wherein the target protein comprises a polypeptide provided herein.

In another aspect, provided herein is a kit comprising an antibody molecule provided herein and instructions for use of the antibody molecule to detect a fusion polypeptide provided herein.

In another aspect, provided herein is a method of reducing an activity or expression of a fusion polypeptide, comprising: optionally, acquiring knowledge of the presence of a fusion polypeptide provided herein; and contacting the fusion polypeptide or a cell expressing the fusion polypeptide with an agent that reduces an activity or expression of the fusion polypeptide. In some embodiments, the contacting step is effected in vitro. In some embodiments, the contacting step is effected in vivo. In some embodiments, the contacting step is effected in a human or animal subject.

In another aspect, provided herein is an anti-cancer agent for use in treating a cancer in a subject, wherein the use comprises acquiring knowledge of the presence of a fusion nucleic acid molecule provided herein or a fusion polypeptide provided herein in the subject. In some embodiments, said anti-cancer agent comprises a kinase inhibitor, e.g., an NTRK inhibitor, e.g., an NTRK1, NTRK2, or NTRK3 inhibitor. In some embodiments, said anti-cancer agent comprises an anti-sense molecule (e.g., targeting a fusion nucleic acid molecule provided herein), an antibody (e.g., targeting a fusion polypeptide provided herein), a peptide, a viral vector-based gene therapy (e.g., targeting a fusion nucleic acid molecule or fusion polypeptide provided herein), or a vaccine. In some embodiments, the kinase inhibitor is administered responsive to a determination of the presence of a fusion nucleic acid molecule provided herein or of a fusion polypeptide provided herein in a sample from said subject. In some embodiments, said use is responsive to acquiring knowledge or information of the presence of a fusion nucleic acid molecule provided herein or of a fusion polypeptide provided herein in said subject. In some embodiments, said use is responsive to acquiring knowledge or information of the presence of a fusion nucleic acid molecule provided herein or a fusion polypeptide provided herein in said subject from another party. In some embodiments, the use comprises receiving a communication of the presence of a fusion nucleic acid molecule provided herein or of a fusion polypeptide provided herein in the subject. In some embodiments, said use is responsive to an identification of the presence of a fusion nucleic acid molecule provided herein or a fusion polypeptide provided herein in the subject, wherein said identification arises from collaboration with another party. In some embodiments, the use comprises determining the presence of a fusion nucleic acid molecule provided herein or a fusion polypeptide provided herein by sequencing, e.g., next-generation sequencing (NGS).

In some embodiments, the fusion is an NTRK3 gene fusion provided herein, and the cancer is selected from the group consisting of a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma.

In some embodiments, the fusion is an NTRK1 gene fusion provided herein, and the cancer is selected from the group consisting of an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, and a brain medulloblastoma.

In some embodiments, the cancer is a colorectal cancer, and the colorectal cancer comprises high microsatellite instability.

In some embodiments, the fusion is an NTRK2 gene fusion provided herein, and the cancer is selected from the group consisting of a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, and a colon adenocarcinoma.

In some embodiments, the cancer does not have an alteration in one or more of ALK, BRAF, ERBB2, EGFR, ROS1, or KRAS. In some embodiments, the cancer has no detectable altered level or activity in one or more of EGFR, KRAS, ALK, ROS1 or RET. In some embodiments, the cancer comprises a tumor mutation burden of 20 mut/mB or more. In some embodiments, the anti-cancer agent comprises a kinase inhibitor that selectively inhibits a kinase activity of a fusion polypeptide provided herein. In some embodiments, the anti-cancer agent comprises one or more kinase inhibitors selected from the group consisting of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo [1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928. In some embodiments, the anti-cancer agent comprises a kinase inhibitor selected from the group consisting of an antisense molecule, a ribozyme, an siRNA, a triple helix-forming oligonucleotide, and a gRNA, wherein the anti-cancer agent hybridizes to a fusion nucleic acid molecule provided herein, or a transcription regulatory region thereof. In some embodiments, the anti-cancer agent is used in combination with a second therapeutic agent or modality. In some embodiments, the fusion nucleic acid molecule or the fusion polypeptide is an NTRK1 fusion provided herein, and the second therapeutic agent comprises an HSP90 inhibitor. In some embodiments, the HSP90 inhibitor comprises a benzoquinone or hygroquinone ansamycin HSP90 inhibitor. In some embodiments, the HSP90 inhibitor comprises one or more of 17-AAG (also known as tanespimycin or CNF-1010), 17-DMAG, AT-13387, AUY-922 (also known as VER-49009), BIIB-021 (CNF-2024), BIIB-028, CCT-018159, CCT-129397, CNF-1010, CU-0305, Geldanamycin, IPI-504, Macbecin I, Macbecin II, MPC-3100, PF-04928473 (SNX-2112), Pochonin, PU-H71, Radanamycin, Radicol, SanA, di-SanA, SNX-5422, STA-9090, or XL-888. In some embodiments, the cancer is a solid tumor.

In another aspect, provided herein is a method for screening for an agent that inhibits the expression or activity of a fusion polypeptide provided herein, comprising: optionally, determining if the fusion polypeptide or a nucleic acid molecule encoding the fusion polypeptide is present; contacting the fusion polypeptide or a host cell expressing the fusion polypeptide with a candidate agent; and detecting a change in a parameter associated with the fusion polypeptide. In some embodiments, said parameter is the expression or an activity of a fusion polypeptide provided herein. In some embodiments, the method further comprises comparing a value for the parameter to a reference value. In some embodiments, the method further comprises comparing a parameter obtained from contacting a sample with the candidate agent to the same parameter obtained from not contacting a sample with the candidate agent. In some embodiments, the method further comprises, if a decrease in the expression or activity of the fusion polypeptide is detected, identifying or classifying the candidate agent as an inhibitor. In some embodiments, said contacting occurs in a cell-free system. In some embodiments, said contacting is effected in vitro, ex vivo, or in vivo. In some embodiments, said parameter is chosen from one or more of: (i) direct binding of the candidate agent to the fusion polypeptide; (ii) a change in a kinase activity of TRKA, TRKB, or TRKC; (iii) a change in an activity of a cell comprising the fusion polypeptide, e.g., a change in proliferation, morphology or tumorigenicity of the cell; (iv) a change in a tumor present in an animal subject, e.g., size, appearance, proliferation, of the tumor; or (v) a change in the level of the fusion polypeptide or of a nucleic acid molecule encoding the fusion polypeptide.

In another aspect, provided herein is a method of detecting the presence of a fusion nucleic acid molecule or of a fusion polypeptide, comprising: (a) detecting a fusion nucleic acid molecule provided herein in a sample; or (b) detecting a fusion polypeptide provided herein in a sample. In some embodiments, said sample comprises fluid, cells, or tissue.

In another aspect, provided herein is a method of detecting the presence of a fusion nucleic acid molecule or of a fusion polypeptide, comprising: (a) directly acquiring knowledge that a fusion nucleic acid molecule provided herein is present in a sample; or (b) directly acquiring knowledge that a fusion polypeptide provided herein is present in a sample; thereby detecting the fusion nucleic acid molecule or the fusion polypeptide in the sample.

In some embodiments, the sample comprises fluid (e.g., blood or serum), cells, or tissue (e.g., a tumor tissue). In some embodiments, the sample comprises a tumor biopsy, a circulating tumor cell, or a circulating tumor nucleic acid. In some embodiments, the sample is acquired from a subject, e.g., a human subject. In some embodiments, the sample is a nucleic acid sample, e.g., a sample comprising cell-free DNA (cfDNA) or circulating tumor DNA (ctDNA). In some embodiments, the fusion nucleic acid molecule is detected in the sample by one or more methods selected from the group consisting of a nucleic acid hybridization assay, an amplification-based assay, a PCR-RFLP assay, real-time PCR, sequencing, a screening analysis, FISH, spectral karyotyping or MFISH, comparative genomic hybridization, in situ hybridization, sequence-specific priming (SSP) PCR, HPLC, and mass-spectrometric genotyping. In some embodiments, the sample is a protein sample. In some embodiments, the fusion polypeptide is detected in the sample by contacting the sample with a reagent which specifically binds to a fusion polypeptide provided herein, and detecting the formation of a complex of the fusion polypeptide and the reagent. In some embodiments, the sample is from a cancer that does not have an alteration in one or more of ALK, BRAF, ERBB2, EGFR, ROS1, or KRAS. In some embodiments, the sample is from a cancer that has no detectable altered level or activity in one or more of EGFR, KRAS, ALK, ROS1 or RET. In some embodiments, the fusion nucleic acid molecule comprises an NTRK3 fusion provided herein or the fusion polypeptide comprises an NTRK3 fusion provided herein, wherein the sample is from a subject having a cancer selected from the group consisting of a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma.

In some embodiments, the fusion nucleic acid molecule comprises an NTRK1 fusion provided herein or the fusion polypeptide comprises an NTRK1 fusion provided herein, wherein the sample is from a subject having a cancer selected from the group consisting of an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, and a brain medulloblastoma. In some embodiments, the cancer is a colorectal cancer, and the colorectal cancer comprises high microsatellite instability.

In some embodiments, the fusion nucleic acid molecule comprises an NTRK2 fusion provided herein or the fusion polypeptide comprises an NTRK2 fusion provided herein, wherein the sample is from a subject having a cancer selected from the group consisting of a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, and a colon adenocarcinoma. In some embodiments, the cancer comprises a tumor mutation burden of 20 mut/mB or more. In some embodiments, wherein the knowledge that the fusion nucleic acid molecule provided herein is present in the sample is acquired by sequencing, wherein a read for a nucleotide position in the fusion nucleic acid molecule is acquired. In some embodiments, the read acquired is compared to a reference nucleotide sequence, optionally, wherein: (a) the fusion nucleic acid molecule comprises an NTRK1 fusion nucleic acid molecule provided herein and the read acquired is compared to a wild-type NTRK1 reference nucleotide sequence or to a wild-type reference nucleotide sequence of a gene of Table A; (b) the fusion nucleic acid molecule comprises an NTRK2 fusion nucleic acid molecule provided herein and the read acquired is compared to a wild-type NTRK2 reference nucleotide sequence or to a wild-type reference nucleotide sequence of a gene of Table F; or (c) the fusion nucleic acid molecule comprises an NTRK3 fusion nucleic acid molecule provided herein and the read acquired is compared to a wild-type NTRK3 reference nucleotide sequence or to a wild-type reference nucleotide sequence of a gene of Table K. In some embodiments, the reagent is labeled with a detectable moiety to facilitate detection of the bound and unbound reagent. In some embodiments, the reagent is an antibody molecule. In some embodiments, the cancer is a solid tumor.

In another aspect, provided herein is a method of evaluating a subject, comprising: identifying, selecting, or obtaining information or knowledge that the subject has participated in a clinical trial or has been treated for a cancer; and acquiring genotype information that identifies a fusion nucleic acid molecule provided herein or a fusion polypeptide provided herein in the subject, wherein the presence of the fusion nucleic acid molecule or of the fusion polypeptide identifies the subject as having an increased risk for, or having a cancer associated with the fusion nucleic acid molecule or the fusion polypeptide. In some embodiments, the method further comprises providing a report to a party. In some embodiments, the party is the subject, a caregiver, a physician, an oncologist, a hospital, a clinic, a third-party payor, an insurance company or a government office. In some embodiments, said report is in electronic, web-based, or paper form. In some embodiments, the report identifies the presence or absence of the fusion nucleic acid molecule or the fusion polypeptide, and optionally comprises an identifier for the subject from which the fusion nucleic acid molecule or the fusion polypeptide was obtained. In some embodiments, said report comprises; information on the role of the fusion nucleic acid molecule or the fusion polypeptide in disease; information on prognosis, resistance, or potential or suggested therapeutic options; information on the likely effectiveness of a therapeutic option, the acceptability of a therapeutic option, or the advisability of applying the therapeutic option to a subject; or information, or a recommendation on the administration of a drug.

In another aspect, provided herein is a method for generating a personalized cancer treatment report, comprising: obtaining a sample from a subject, detecting a fusion nucleic acid molecule provided herein or a fusion polypeptide provided herein in the sample; selecting a treatment based on the fusion nucleic acid molecule or the fusion polypeptide detected; and providing a report comprising information on the fusion nucleic acid molecule or the fusion polypeptide detected and the treatment selected.

In another aspect, provided herein is a method of identifying an individual having cancer who may benefit from a treatment comprising a kinase inhibitor, the method comprising detecting a gene fusion in a sample from the individual, wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K; wherein the presence of the gene fusion in the sample identifies the individual as one who may benefit from the treatment comprising a kinase inhibitor.

In another aspect, provided herein is a method of selecting a therapy for an individual having cancer, the method comprising detecting a gene fusion in a sample from the individual, wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K; wherein the presence of the gene fusion in the sample identifies the individual as one who may benefit from a treatment comprising a kinase inhibitor.

In another aspect, provided herein is a method of identifying one or more treatment options for an individual having cancer, the method comprising: (a) detecting a gene fusion in a sample from the individual, wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K; and (b) generating a report comprising one or more treatment options identified for the individual based at least in part on the presence of the gene fusion in the sample, wherein the one or more treatment options comprise a treatment comprising a kinase inhibitor.

In another aspect, provided herein is a method of identifying one or more treatment options for an individual having cancer, the method comprising: (a) acquiring knowledge of a gene fusion in a sample from the individual, wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K; and (b) generating a report comprising one or more treatment options identified for the individual based at least in part on said knowledge, wherein the one or more treatment options comprise a treatment comprising a kinase inhibitor.

In another aspect, provided herein is a method of selecting a treatment for a subject having cancer, comprising acquiring knowledge of a gene fusion in a sample from a subject having cancer (e.g., by sequencing, such as next-generation sequencing or sequencing by mass spectrometry), wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K; wherein responsive to the acquisition of said knowledge: (i) the subject is classified as a candidate to receive a treatment comprising a kinase inhibitor; and/or (ii) the subject is identified as likely to respond to a treatment comprising a kinase inhibitor. In some embodiments, said method further comprises, optionally providing a report to another party, wherein said report comprises: information on the role of the NTRK1, NTRK2, or NTRK3 gene fusion, or wildtype sequence, in disease; information on prognosis, resistance, or potential or suggested therapeutic options for the subject; information on the likely effectiveness of a therapeutic option, the acceptability of a therapeutic option, or the advisability of applying a therapeutic option to the subject; or information, or a recommendation on, the administration of a drug to the subject.

In another aspect, provided herein is a method of treating or delaying progression of cancer, comprising administering to an individual an effective amount of a treatment comprising a kinase inhibitor, wherein the cancer comprises a gene fusion, wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K.

In another aspect, provided herein is a method of treating or delaying progression of cancer, comprising, responsive to knowledge of a gene fusion in a sample from an individual, administering to the individual an effective amount of a treatment comprising a kinase inhibitor, wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K.

In another aspect, provided herein is a method of treating or delaying progression of cancer, comprising: (a) detecting a gene fusion in a sample from an individual, wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K; and (b) administering to the individual an effective amount of a treatment comprising a kinase inhibitor.

In another aspect, provided herein is a method of treating or delaying progression of cancer, comprising: (a) acquiring knowledge of a gene fusion in a sample from an individual, wherein the gene fusion is an NTRK1, NTRK2, or NTRK3 gene fusion, wherein: (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K; and (b) responsive to said knowledge, administering to the individual an effective amount of a treatment comprising a kinase inhibitor.

In some embodiments, the gene fusion is an NTRK3 gene fusion, and wherein the cancer is selected from the group consisting of melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma.

In some embodiments, the gene fusion is an NTRK1 gene fusion, and wherein the cancer is selected from the group consisting of an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, and a brain medulloblastoma.

In some embodiments, the gene fusion is an NTRK2 gene fusion, and wherein the cancer is selected from the group consisting of a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, and a colon adenocarcinoma.

In some embodiments, the cancer is a solid tumor.

In some embodiments, the cancer is a colorectal cancer, and the colorectal cancer comprises high microsatellite instability. In some embodiments, the cancer does not have an alteration in one or more of ALK, BRAF, ERBB2, EGFR, ROS1, or KRAS. In some embodiments, the cancer has no detectable altered level or activity of one or more of EGFR, KRAS, ALK, ROS1 or RET. In some embodiments, the cancer comprises a tumor mutation burden of 20 mut/mB or more.

In some embodiments, the kinase inhibitor is selected from the group consisting of AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928. In some embodiments, the kinase inhibitor is larotrectinib, AZ-23, danusertib (PHA-739358), entrectinib, lestaurtinib (CEP-701), AZD7451, belizatinib, selitrectinib, or crizotinib. In some embodiments, the kinase inhibitor is selected from the group consisting of an antisense molecule, a ribozyme, an siRNA, a triple helix-forming oligonucleotide, and a gRNA.

In some embodiments, the treatment comprising a kinase inhibitor further comprises a second therapeutic agent. In some embodiments, the gene fusion is an NTRK1 gene fusion, wherein the treatment comprising a kinase inhibitor further comprises an HSP90 inhibitor. In some embodiments, the HSP90 inhibitor comprises a benzoquinone HSP90 inhibitor or a hygroquinone ansamycin HSP90 inhibitor. In some embodiments, the HSP90 inhibitor comprises one or more of 17-AAG, 17-DMAG, AT-13387, AUY-922, BIIB-021 (CNF-2024), BIIB-028, CCT-018159, CCT-129397, CNF-1010, CU-0305, Geldanamycin, IPI-504, Macbecin I, Macbecin II, MPC-3100, PF-04928473 (SNX-2112), Pochonin, PU-H71, Radanamycin, Radicol, SanA, di-SanA, SNX-5422, STA-9090, or XL-888.

In another aspect, provided herein is a method of detecting an NTRK1, NTRK2, or NTRK3 gene fusion, the method comprising: (a) detecting an NTRK1 gene fusion in a sample from an individual (e.g., detecting in vitro), wherein the NTRK1 gene fusion comprises a fusion of an NTRK1 gene and a gene of Table A; (b) detecting an NTRK2 gene fusion in a sample from an individual (e.g., detecting in vitro), wherein the NTRK2 gene fusion comprises a fusion of an NTRK2 gene and a gene of Table F; or (c) detecting an NTRK3 gene fusion in a sample from an individual (e.g., detecting in vitro), wherein the NTRK3 gene fusion comprises a fusion of an NTRK3 gene and a gene of Table K.

In another aspect, provided herein is a method of diagnosing and/or assessing an NTRK1, NTRK2, or NTRK3 gene fusion, the method comprising: (a) detecting (e.g., in vitro) an NTRK1 gene fusion in a sample from an individual; and providing a diagnosis and/or assessment of an NTRK1 gene fusion, wherein the NTRK1 gene fusion comprises a fusion of an NTRK1 gene and a gene of Table A; (b) detecting (e.g., in vitro) an NTRK2 gene fusion in a sample from an individual; and providing a diagnosis and/or assessment of an NTRK2 gene fusion, wherein the NTRK2 gene fusion comprises a fusion of an NTRK2 gene and a gene of Table F; or (c) detecting (e.g., in vitro) an NTRK3 gene fusion in a sample from an individual; and providing a diagnosis and/or assessment of an NTRK3 gene fusion, wherein the NTRK3 gene fusion comprises a fusion of an NTRK3 gene and a gene of Table K.

In another aspect, provided herein is a kinase inhibitor for use in a method of treating or delaying progression of cancer, wherein the method comprises administering the kinase inhibitor to an individual, wherein an NTRK1, NTRK2, or NTRK3 gene fusion is detected in a sample obtained from the individual, wherein the (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K.

In another aspect, provided herein is a kinase inhibitor for use in the manufacture of a medicament for treating or delaying progression of cancer, wherein the medicament is to be administered to an individual, wherein an NTRK1, NTRK2, or NTRK3 gene fusion has been detected in a sample obtained from the individual, wherein the (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K.

In some embodiments, the kinase inhibitor is selected from the group consisting of AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928.

In some embodiments, the gene fusion is an NTRK3 gene fusion, and the cancer is selected from the group consisting of a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma. In some embodiments, the gene fusion is an NTRK1 gene fusion, and the cancer is selected from the group consisting of an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, and a brain medulloblastoma. In some embodiments, the cancer is a colorectal cancer, and the colorectal cancer comprises high microsatellite instability. In some embodiments, the gene fusion is an NTRK2 gene fusion, and the cancer is selected from the group consisting of a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, and a colon adenocarcinoma. In some embodiments, the cancer does not have an alteration in one or more of ALK, BRAF, ERBB2, EGFR, ROS1, or KRAS. In some embodiments, the cancer has no detectable altered level or activity of one or more of EGFR, KRAS, ALK, ROS1 or RET. In some embodiments, the cancer comprises a tumor mutation burden of 20 mut/mB or more. In some embodiments, the cancer is a solid tumor.

In some embodiments, the kinase inhibitor is administered to the individual in combination with a second therapeutic agent, or the medicament is to be administered to the individual in combination with a second therapeutic agent. In some embodiments, the kinase inhibitor is administered to the individual in combination with an HSP90 inhibitor, or the medicament is to be administered to the individual in combination with an HSP90 inhibitor. In some embodiments, the HSP90 inhibitor comprises a benzoquinone HSP90 inhibitor or a hygroquinone ansamycin HSP90 inhibitor. In some embodiments, the HSP90 inhibitor comprises one or more of 17-AAG, 17-DMAG, AT-13387, AUY-922, BIIB-021 (CNF-2024), BIIB-028, CCT-018159, CCT-129397, CNF-1010, CU-0305, Geldanamycin, IPI-504, Macbecin I, Macbecin II, MPC-3100, PF-04928473 (SNX-2112), Pochonin, PU-H71, Radanamycin, Radicol, SanA, di-SanA, SNX-5422, STA-9090, or XL-888.

In another aspect, provided herein is an in vitro use of one or more oligonucleotides for detecting: (a) an NTRK1 gene fusion, wherein the NTRK1 gene fusion comprises a fusion of an NTRK1 gene and a gene of Table A; (b) an NTRK2 gene fusion, wherein the NTRK2 gene fusion comprises a fusion of an NTRK2 gene and a gene of Table F; or (c) an NTRK3 gene fusion, wherein the NTRK3 gene fusion comprises a fusion of an NTRK3 gene and a gene of Table K.

In another aspect, provided herein is a kit comprising one or more oligonucleotides for detecting: (a) an NTRK1 gene fusion, wherein the NTRK1 gene fusion comprises a fusion of an NTRK1 gene and a gene of Table A; (b) an NTRK2 gene fusion, wherein the NTRK2 gene fusion comprises a fusion of an NTRK2 gene and a gene of Table F; or (c) an NTRK3 gene fusion, wherein the NTRK3 gene fusion comprises a fusion of an NTRK3 gene and a gene of Table K.

In another aspect, provided herein is an isolated NTRK1 fusion nucleic acid molecule comprising: (i) a nucleotide sequence comprising one or more exons of a gene selected from the group consisting of KIRREL1, CCDC88C, DCTN1, EML4, PRKAR1A, PTPRC, ARGLU1, MEX3A, SEL1L, NAB2, DUSP10, NLGN1, DCST1, ACO1, EFNA3, CABLES1, RAB25, CUL4A, SEMA4B, PTP4A2, ZBTB1, SMG5, SFPQ, NOS1AP, and BGLAP, or a nucleotide sequence at least 70%, 75%, 80%, 85%, 90%, 91%, 92%, 93%, 94% 95%, 96%, 97%, 98%, 99%, or 99.5% identical thereto, and one or more exons of an NTRK1 gene or a nucleotide sequence at least 70%, 75%, 80%, 85%, 90%, 91%, 92%, 93%, 94% 95%, 96%, 97%, 98%, 99%, or 99.5% identical thereto; optionally, wherein: (a) the fusion is a KIRREL-NTRK1 fusion, wherein the fusion results from a breakpoint in intron 3 of KIRREL and a breakpoint in intron 7 of NTRK1, or wherein the fusion results from a breakpoint at chr1:158050567 (plus or minus 10, 20, 30, 40, 50, 60, 70, 80, 90, 100, or more nucleotides) and chr1:156842050 (plus or minus 10, 20, 30, 40, 50, 60, 70, 80, 90, 100, or more nucleotides), (b) the fusion is a KIRREL-NTRK1 fusion, wherein the fusion results from a breakpoint at chr1: 158061720 (plus or minus 10, 20, 30, 40, 50, 60, 70, 80, 90, 100, or more nucleotides) and chr1:156843904 (plus or minus 10, 20, 30, 40, 50, 60, 70, 80, 90, 100, or more nucleotides), (c) the fusion is a CCDC88C-NTRK1 fusion, wherein the fusion results from a breakpoint in intron 12 of CCDC88C and a breakpoint in intron 11 of NTRK1, or wherein the fusion results from a breakpoint at chr14: 91790206 (plus or minus 10, 20, 30, 40, 50, 60, 70, 80, 90, 100, or more nucleotides) and chr1:156845277 (plus or minus 10, 20, 30, 40, 50, 60, 70, 80, 90, 100, or more nucleotides), (e) the fusion is a DCTN1-NTRK1 fusion, wherein the fusion results from a breakpoint at chr2: 74592202 (plus or minus 10, 20, 30, 40, 50, 60, 70, 80, 90, 100, or more nucleotides) and chr1:156845312 (plus or minus 10, 20, 30, 40, 50, 60, 70, 80, 90, 100, or more nucleotides), (f) the fusion is a EML4-NTRK1 fusion, wherein the fusion results from a breakpoint in intron 18 of EML4 and a breakpoint in intron 11 of NTRK1, or wherein the fusion results from a breakpoint at chr2:42543233 (plus or minus 10, 20, 30, 40, 50, 60, 70, 80, 90, 100, or more nucleotides) and chr1:156845156 (plus or minus 10, 20, 30, 40, 50, 60, 70, 80, 90, 100, or more nucleotides), (g) the fusion is a PRKAR1A-NTRK1 fusion, wherein the fusion results from a breakpoint in intron 8 of PRKAR1A and a breakpoint in intron 11 of NTRK1, or wherein the fusion results from a breakpoint at chr17:66524061 (plus or minus 10, 20, 30, 40, 50, 60, 70, 80, 90, 100, or more nucleotides) and chr1:156844904 (plus or minus 10, 20, 30, 40, 50, 60, 70, 80, 90, 100, or more nucleotides), (h) the fusion is a PTPRC-NTRK1 fusion, wherein the fusion results from a breakpoint in intron 2 of PTPRC and a breakpoint in intron 7 of NTRK1, or wherein the fusion results from a breakpoint at chr1:198634489 (plus or minus 10, 20, 30, 40, 50, 60, 70, 80, 90, 100, or more nucleotides) and/or chr1:156841758 (plus or minus 10, 20, 30, 40, 50, 60, 70, 80, 90, 100, or more nucleotides), (i) the fusion is a ARGLU1-NTRK1 fusion, wherein the fusion results from a breakpoint in intron 3 of ARGLU1 and a breakpoint in intron 10 of NTRK1, or wherein the fusion results from a breakpoint at chr13: 107196889 (plus or minus 10, 20, 30, 40, 50, 60, 70, 80, 90, 100, or more nucleotides) and chr1:156844485 (plus or minus 10, 20, 30, 40, 50, 60, 70, 80, 90, 100, or more nucleotides), (j) the fusion is a MEX3A-NTRK1 fusion, wherein the fusion results from a breakpoint in intron 1 of MEX3A and a breakpoint in intron 8 of NTRK1, or wherein the fusion results from a breakpoint at chr1:156051072 (plus or minus 10, 20, 30, 40, 50, 60, 70, 80, 90, 100, or more nucleotides) and chr1:156843781 (plus or minus 10, 20, 30, 40, 50, 60, 70, 80, 90, 100, or more nucleotides), (k) the fusion is a SEL1L-NTRK1 fusion, wherein the fusion results from a breakpoint in intron 1 of SEL1L and a breakpoint in intron 7 of NTRK1, or wherein the fusion results from a breakpoint at chr14:81996404 (plus or minus 10, 20, 30, 40, 50, 60, 70, 80, 90, 100, or more nucleotides) and chr1: 156841878 (plus or minus 10, 20, 30, 40, 50, 60, 70, 80, 90, 100, or more nucleotides), (l) the fusion is a NAB2-NTRK1 fusion, wherein the fusion results from a breakpoint at chr12:57486978 (plus or minus 10, 20, 30, 40, 50, 60, 70, 80, 90, 100, or more nucleotides) and chr1:156844363 (plus or minus 10, 20, 30, 40, 50, 60, 70, 80, 90, 100, or more nucleotides), (m) the fusion is a NTRK1-DUSP10 fusion, wherein the fusion results from a breakpoint in intron 11 of NTRK1 and a breakpoint in intron 2 of DUSP10, or wherein the fusion results from a breakpoint at chr1:156845080 (plus or minus 10, 20, 30, 40, 50, 60, 70, 80, 90, 100, or more nucleotides) and chr1:221901034 (plus or minus 10, 20, 30, 40, 50, 60, 70, 80, 90, 100, or more nucleotides), (n) the fusion is a NTRK1-NLGN1 fusion, wherein the fusion results from a breakpoint in intron 7 of NTRK1 and a breakpoint in intron 4 of NLGN1, or wherein the fusion results from a breakpoint at chr1:156842275 (plus or minus 10, 20, 30, 40, 50, 60, 70, 80, 90, 100, or more nucleotides) and chr3:173545781 (plus or minus 10, 20, 30, 40, 50, 60, 70, 80, 90, 100, or more nucleotides), (o) the fusion is a NTRK1-DCST1 fusion, wherein the fusion results from a breakpoint in intron 3 of NTRK1 and a breakpoint in intron 10 of DCST1, or wherein the fusion results from a breakpoint at chr1:156834370-156834665 (plus or minus 10, 20, 30, 40, 50, 60, 70, 80, 90, 100, or more nucleotides) and chr1:155016200-155016439 (plus or minus 10, 20, 30, 40, 50, 60, 70, 80, 90, 100, or more nucleotides), (p) the fusion is a NTRK1-ACO1 fusion, wherein the fusion results from a breakpoint in intron 2 of NTRK1 and a breakpoint in intron 11 of ACO1, or wherein the fusion results from a breakpoint at chr1:156812048 (plus or minus 10, 20, 30, 40, 50, 60, 70, 80, 90, 100, or more nucleotides) and chr9:32426121 (plus or minus 10, 20, 30, 40, 50, 60, 70, 80, 90, 100, or more nucleotides), (q) the fusion is a NTRK1-EFNA3 fusion, wherein the fusion results from a breakpoint in intron 1 of NTRK1 and a breakpoint in intron 1 of EFNA3, or wherein the fusion results from a breakpoint at chr1:156785743 (plus or minus 10, 20, 30, 40, 50, 60, 70, 80, 90, 100, or more nucleotides) and chr1:155056097 (plus or minus 10, 20, 30, 40, 50, 60, 70, 80, 90, 100, or more nucleotides), (r) the fusion is a CABLES1-NTRK1 fusion, wherein the fusion results from a breakpoint in intron 4 of CABLES1 and a breakpoint in intron 7 of NTRK1, or wherein the fusion results from a breakpoint at chr18:20805274 (plus or minus 10, 20, 30, 40, 50, 60, 70, 80, 90, 100, or more nucleotides) and chr1:156842301 (plus or minus 10, 20, 30, 40, 50, 60, 70, 80, 90, 100, or more nucleotides), (s) the fusion is a NTRK1-RAB25 fusion, wherein the fusion results from a breakpoint in intron 10 of NTRK1 and a breakpoint in intron 1 of RAB25, or wherein the fusion results from a breakpoint at chr1:156844459 (plus or minus 10, 20, 30, 40, 50, 60, 70, 80, 90, 100, or more nucleotides) and chr1:156032830 (plus or minus 10, 20, 30, 40, 50, 60, 70, 80, 90, 100, or more nucleotides), (t) the fusion is a CUL4A-NTRK1 fusion, wherein the fusion results from a breakpoint in intron 1 of CUL4A, or wherein the fusion results from a breakpoint at chr13:113864171 (plus or minus 10, 20, 30, 40, 50, 60, 70, 80, 90, 100, or more nucleotides) and chr1:156844377-156844417 (plus or minus 10, 20, 30, 40, 50, 60, 70, 80, 90, 100, or more nucleotides), (u) the fusion is a NTRK1-SEMA4B fusion, wherein the fusion results from a breakpoint in intron 8 of NTRK1 and a breakpoint in intron 1 of SEMA4B, or wherein the fusion results from a breakpoint at chr1:156843854 (plus or minus 10, 20, 30, 40, 50, 60, 70, 80, 90, 100, or more nucleotides) and chr15:90730266 (plus or minus 10, 20, 30, 40, 50, 60, 70, 80, 90, 100, or more nucleotides), (v) the fusion is a PTP4A2-NTRK1 fusion, wherein the fusion results from a breakpoint at chr1:32385259 (plus or minus 10, 20, 30, 40, 50, 60, 70, 80, 90, 100, or more nucleotides) and chr1:156834146 (plus or minus 10, 20, 30, 40, 50, 60, 70, 80, 90, 100, or more nucleotides), (w) the fusion is a ZBTB1-NTRK1 fusion, wherein the fusion results from a breakpoint at chr14:64988205 (plus or minus 10, 20, 30, 40, 50, 60, 70, 80, 90, 100, or more nucleotides) and chr1:156834146 (plus or minus 10, 20, 30, 40, 50, 60, 70, 80, 90, 100, or more nucleotides), (x) the fusion is a SMG5-NTRK1 fusion, wherein the fusion results from a breakpoint in exon 1 of SMG5 and a breakpoint in intron 12 of NTRK1, or wherein the fusion results from a breakpoint at chr1:156252489 (plus or minus 10, 20, 30, 40, 50, 60, 70, 80, 90, 100, or more nucleotides) and chr1:156845817 (plus or minus 10, 20, 30, 40, 50, 60, 70, 80, 90, 100, or more nucleotides), (y) the fusion is a SFPQ-NTRK1 fusion, wherein the fusion results from a breakpoint in exon 10 of SFPQ and a breakpoint in intron 8 of NTRK1 or wherein the fusion results from a breakpoint at chr1:35650140 (plus or minus 10, 20, 30, 40, 50, 60, 70, 80, 90, 100, or more nucleotides) and chr1:156844231 (plus or minus 10, 20, 30, 40, 50, 60, 70, 80, 90, 100, or more nucleotides), (z) the fusion is a NOS1AP-NTRK1 fusion, wherein the fusion results from a breakpoint in exon 10 of NOS1AP and a breakpoint in intron 8 of NTRK1, or wherein the fusion results from a breakpoint at chr1:162337088 (plus or minus 10, 20, 30, 40, 50, 60, 70, 80, 90, 100, or more nucleotides) and/or chr1:156843914 (plus or minus 10, 20, 30, 40, 50, 60, 70, 80, 90, 100, or more nucleotides), (aa) the fusion is a NTRK1-BGLAP fusion, wherein the fusion results from a breakpoint in intron 11 of NTRK1 and a breakpoint in exon 1 of BGLAP, or wherein the fusion results from a breakpoint at chr1:156845233 (plus or minus 10, 20, 30, 40, 50, 60, 70, 80, 90, 100, or more nucleotides) and/or chr1:156211955 (plus or minus 10, 20, 30, 40, 50, 60, 70, 80, 90, 100, or more nucleotides), (bb) the fusion is a MEX3A-NTRK1 fusion, wherein the fusion results from a breakpoint at 156843777-156843890 (plus or minus 10, 20, 30, 40, 50, 60, 70, 80, 90, 100, or more nucleotides) on Chromosome 1 and a breakpoint at 156051070-156051319 (plus or minus 10, 20, 30, 40, 50, 60, 70, 80, 90, 100, or more nucleotides) on Chromosome 1; (ii) a nucleotide sequence of any one of SEQ ID NOs: 5 or 67-80, or a nucleotide sequence at least 70%, 75%, 80%, 85%, 90%, 91%, 92%, 93%, 94% 95%, 96%, 97%, 98%, 99%, or 99.5% identical thereto; (iii) a nucleotide sequence encoding an amino acid sequence of any one of SEQ ID NOs: 81-94, or an amino acid sequence at least 70%, 75%, 80%, 85%, 90%, 91%, 92%, 93%, 94% 95%, 96%, 97%, 98%, 99%, or 99.5% identical to any one of SEQ ID NOs: 81-94; (iv) a nucleotide sequence comprising in the 5' to 3' direction: (a) exons 1-3 of KIRREL and exons 8-17 of NTRK1, (b) exons 1-11 of KIRREL and exons 10-17 of NTRK1, (c) exons 1-12 of CCDC88C and exons 12-17 of NTRK1, (d) exons 1-26 of DCTN1 and exons 12-17 of NTRK1, (e) exons 1-18 of EML4 and exons 12-17 of NTRK1, (f) exons 1-8 of PRKAR1A and exons 12-17 of NTRK1, (g) exons 1-2 of PTPRC and exons 8-17 of NTRK1, (h) exons 1-3 of ARGLU1 and exons 11-17 of NTRK1, (i) exon 1 of MEX3A and exons 9-17 of NTRK1, (j) exon 1 of SEL1L and exons 8-17 of NTRK1, (k) exons 1-5 of NAB2 and exons 10-17 of NTRK1, (1) exons 1-11 of NTRK1 and exons 3-4 of DUSP10, (m) exons 1-7 of NTRK1 and exons 5-7 of NLGN1, (n) exons 1-3 of NTRK1 and exons 11-17 of DCST1, (o) exons 1-2 of NTRK1 and exons 12-21 of ACO1, (p) exon 1 of NTRK1 and exons 2-5 of EFNA3, (q) exons 1-4 of CABLES1 and exons 8-17 of NTRK1, (r) exons 1-10 of NTRK1 and exons 2-5 of RAB25, (s) exon 1 of CUL4A and exons 10-17 of NTRK1, (t) exons 1-8 of NTRK1 and exons 2-15 of SEMA4B, (u) exon 1 of PTP4A2 and exons 3-17 of NTRK1, (v) exon 1 of ZBTB1 and exons 2-17 of NTRK1, (w) exon 1 of SMG5 and exons 13-17 of NTRK1, (x) exons 1-10 of SFPQ and exons 9-17 of NTRK1, (y) exons 1-10 of NOS1AP and exons 9-17 of NTRK1, or (z) exons 1-11 of NTRK1 and exons 2-4 BGLAP; or (v) a fragment of any of (i)-(iv), comprising the junction between NTRK1 and a gene selected from the group consisting of KIRREL1, CCDC88C, DCTN1, EML4, PRKAR1A, PTPRC, ARGLU1, MEX3A, SEL1L, NAB2, DUSP10, NLGN1, DCST1, ACO1, EFNA3, CABLES1, RAB25, CUL4A, SEMA4B, PTP4A2, ZBTB1, SMG5, SFPQ, NOS1AP, and BGLAP, wherein the fragment comprises between about 5 to about 300 nucleotides, between about 5 to about 25 nucleotides, between about 100 to about 300 nucleotides, between about 130 to about 230 nucleotides, or between about 150 to about 200 nucleotides.

In another aspect, provided herein is a nucleic acid molecule that is capable of hybridizing to an NTRK1 nucleic acid molecule provided herein, optionally wherein the nucleic acid molecule that is capable of hybridizing comprises between about 50 and 1000 nucleotides, between about 50 and 500 nucleotides, between about 100 and 500 nucleotides, between about 100 and 300 nucleotides, between about 130 and 230 nucleotides, between about 150 and 200 nucleotides, about 50 nucleotides, about 100 nucleotides, about 150 nucleotides, about 200 nucleotides, about 250 nucleotides, about 300 nucleotides, about 400 nucleotides, about 500 nucleotides, about 750 nucleotides, or about 1000 nucleotides. In some embodiments, the nucleic acid molecule that is capable of hybridizing is about 150 nucleotides.

In another aspect, provided herein is an isolated NTRK2 fusion nucleic acid molecule comprising: (i) a nucleotide sequence comprising one or more exons of a gene selected from the group consisting of PPP6R3, FOXB2, NOD1, DENND1A, PRRX1, FAM117B, PAIP1, CTDSP2, PCSK5, and THADA, or a nucleotide sequence at least 70%, 75%, 80%, 85%, 90%, 91%, 92%, 93%, 94% 95%, 96%, 97%, 98%, 99%, or 99.5% identical thereto, and one or more exons of an NTRK2 gene or a nucleotide sequence at least 70%, 75%, 80%, 85%, 90%, 91%, 92%, 93%, 94% 95%, 96%, 97%, 98%, 99%, or 99.5% identical thereto; optionally, wherein:

(a) the fusion is a PPP6R3-NTRK2 fusion, wherein the fusion results from a breakpoint in intron 2 of NTRK1 and a breakpoint in exon 13 of PPP6R3, or wherein the fusion results from a breakpoint at chr11:68341673 (plus or minus 10, 20, 30, 40, 50, 60, 70, 80, 90, 100, or more nucleotides) and chr9:87285944 (plus or minus 10, 20, 30, 40, 50, 60, 70, 80, 90, 100, or more nucleotides), (b) the fusion is a FOXB2-NTRK2 fusion, wherein the fusion results from a breakpoint at Chr9:

87358998-87359350 (plus or minus 10, 20, 30, 40, 50, 60, 70, 80, 90, 100, or more nucleotides) and Chr9: 79635277-79635505 (plus or minus 10, 20, 30, 40, 50, 60, 70, 80, 90, 100, or more nucleotides), (c) the fusion is a NOD1-NTRK2 fusion, wherein the fusion results from a breakpoint at Chr9: 87322630-87323000 (plus or minus 10, 20, 30, 40, 50, 60, 70, 80, 90, 100, or more nucleotides) and Chr7:30485058-30485317 (plus or minus 10, 20, 30, 40, 50, 60, 70, 80, 90, 100, or more nucleotides), (d) the fusion is a DENND1A-NTRK2 fusion, wherein the fusion results from a breakpoint in intron 8 of DENND1A and a breakpoint in intron 13 of NTRK2, or wherein the fusion results from a breakpoint at chr9:126418582 (plus or minus 10, 20, 30, 40, 50, 60, 70, 80, 90, 100, or more nucleotides) and chr9:87476025 (plus or minus 10, 20, 30, 40, 50, 60, 70, 80, 90, 100, or more nucleotides), (e) the fusion is a PRRX1-NTRK2 fusion, wherein the fusion results from a breakpoint at chr1:170695373 (plus or minus 10, 20, 30, 40, 50, 60, 70, 80, 90, 100, or more nucleotides) and chr9:87325546 (plus or minus 10, 20, 30, 40, 50, 60, 70, 80, 90, 100, or more nucleotides), (f) the fusion is a FAM117B-NTRK2 fusion, wherein the fusion results from a breakpoint in intron 1 of FAM117B and a breakpoint in intron 12 of NTRK2, or wherein the fusion results from a breakpoint at chr2: 203540407 (plus or minus 10, 20, 30, 40, 50, 60, 70, 80, 90, 100, or more nucleotides) and chr9:87475796 (plus or minus 10, 20, 30, 40, 50, 60, 70, 80, 90, 100, or more nucleotides), (g) the fusion is a PAIP1-NTRK2 fusion, wherein the fusion results from a breakpoint in intron 9 of PAIP1 and a breakpoint in intron 10 of NTRK2, or wherein the fusion results from a breakpoint at chr5: 43531836 (plus or minus 10, 20, 30, 40, 50, 60, 70, 80, 90, 100, or more nucleotides) and chr9:87358662 (plus or minus 10, 20, 30, 40, 50, 60, 70, 80, 90, 100, or more nucleotides), (h) the fusion is a CTDSP2-NTRK2 fusion, wherein the fusion results from a breakpoint at chr12:58240155 (plus or minus 10, 20, 30, 40, 50, 60, 70, 80, 90, 100, or more nucleotides) and chr9: 87482158 (plus or minus 10, 20, 30, 40, 50, 60, 70, 80, 90, 100, or more nucleotides), (i) the fusion is a PCSK5-NTRK2 fusion, wherein the fusion results from a breakpoint in intron 24 of PCSK5 and a breakpoint in intron 10 of NTRK2, or wherein the fusion results from a breakpoint at chr9:78863564 (plus or minus 10, 20, 30, 40, 50, 60, 70, 80, 90, 100, or more nucleotides) and chr9:87359395 (plus or minus 10, 20, 30, 40, 50, 60, 70, 80, 90, 100, or more nucleotides), or (j) the fusion is a THADA-NTRK2 fusion, wherein the fusion results from a breakpoint in intron 36 of THADA and a breakpoint in exon 9 of NTRK2, or wherein the fusion results from a breakpoint at chr2:43472620 (plus or minus 10, 20, 30, 40, 50, 60, 70, 80, 90, 100, or more nucleotides) and chr9:87342768 (plus or minus 10, 20, 30, 40, 50, 60, 70, 80, 90, 100, or more nucleotides); or (ii) a nucleotide sequence of any one of SEQ ID NOs: 118-123, or a nucleotide sequence at least 70%, 75%, 80%, 85%, 90%, 91%, 92%, 93%, 94% 95%, 96%, 97%, 98%, 99%, or 99.5% identical thereto; (iii) a nucleotide sequence encoding an amino acid sequence of any one of SEQ ID NOs: 124-129, or an amino acid sequence at least 70%, 75%, 80%, 85%, 90%, 91%, 92%, 93%, 94% 95%, 96%, 97%, 98%, 99%, or 99.5% identical to any one of SEQ ID NOs: 124-129; (iv) a nucleotide sequence comprising in the 5' to 3' direction: (a) exons 1-13 of PPP6R3 and exons 3-19 of NTRK2, (b) exon 1 of FOXB2 and exon 11 of NTRK2, (c) exon 9 of NOD1 and exon 6 of NTRK2, (d) exons 1-8 of DENND1A and exons 14-19 of NTRK2, (e) exons 1-3 of PRRX1 and exons 5-19 of NTRK2, (f) exon 1 of FAM117B and exons 13-19 of NTRK2, (g) exons 1-9 of PAIP1 and exons 11-19 of NTRK2, (h) exon 1 of CTDSP2 and exons 14-19 of NTRK2, (i) exons 1-24 of PCSK5 and exons 11-19 of NTRK2, or (j) exons 1-36 of THADA and exons 9-19 NTRK2; or (v) a fragment of any of (i)-(iv), comprising the junction between NTRK2 and a gene selected from the group consisting of PPP6R3, FOXB2, NOD1, DENND1A, PRRX1, FAM117B, PAIP1, CTDSP2, PCSK5, and THADA, wherein the fragment comprises between about 5 to about 300 nucleotides, between about 5 to about 25 nucleotides, between about 100 to about 300 nucleotides, between about 130 to about 230 nucleotides, or between about 150 to about 200 nucleotides.

In another aspect, provided herein a nucleic acid molecule that is capable of hybridizing to an NTRK2 nucleic acid molecule provided herein, optionally wherein the nucleic acid molecule that is capable of hybridizing comprises between about 50 and 1000 nucleotides, between about 50 and 500 nucleotides, between about 100 and 500 nucleotides, between about 100 and 300 nucleotides, between about 130 and 230 nucleotides, between about 150 and 200 nucleotides, about 50 nucleotides, about 100 nucleotides, about 150 nucleotides, about 200 nucleotides, about 250 nucleotides, about 300 nucleotides, about 400 nucleotides, about 500 nucleotides, about 750 nucleotides, or about 1000 nucleotides. In some embodiments, the nucleic acid molecule that is capable of hybridizing is about 150 nucleotides.

In another aspect, provided herein is an isolated NTRK3 fusion nucleic acid molecule comprising: (i) a nucleotide sequence comprising one or more exons of a gene selected from the group consisting of ADAMTSL3, BLM, ACAN, MYO9A, CDK12, EFTUD1/EFL1, LRRK1, HMBOX1, RUNX1, DLG1, AMMECR1, TNRC6A, IQGAP1, RORA, CHST11, ZSCAN2, FANCI, PKM, and CARM1, or a nucleotide sequence at least 70%, 75%, 80%, 85%, 90%, 91%, 92%, 93%, 94% 95%, 96%, 97%, 98%, 99%, or 99.5% identical thereto, and one or more exons of an NTRK3 gene or a nucleotide sequence at least 70%, 75%, 80%, 85%, 90%, 91%, 92%, 93%, 94% 95%, 96%, 97%, 98%, 99%, or 99.5% identical thereto; optionally, wherein: (a) the fusion is a NTRK3-ADAMTSL3 fusion, wherein the fusion results from a breakpoint at 88576047-88576349 (plus or minus 10, 20, 30, 40, 50, 60, 70, 80, 90, 100, or more nucleotides) on chromosome 15 and 84564247-84564478 (plus or minus 10, 20, 30, 40, 50, 60, 70, 80, 90, 100, or more nucleotides) on chromosome 15, (b) the fusion is a BLM-NTRK3 fusion, wherein the fusion results from a breakpoint at 88576055-88576336 (plus or minus 10, 20, 30, 40, 50, 60, 70, 80, 90, 100, or more nucleotides) on chromosome 15 and 91294841-91295039 (plus or minus 10, 20, 30, 40, 50, 60, 70, 80, 90, 100, or more nucleotides) on chromosome 15, (c) the fusion is a NTRK3-ACAN fusion, wherein the fusion results from a breakpoint at 88680708-88680926 (plus or minus 10, 20, 30, 40, 50, 60, 70, 80, 90, 100, or more nucleotides) on chromosome 15 and 89376765-89377051 (plus or minus 10, 20, 30, 40, 50, 60, 70, 80, 90, 100, or more nucleotides) on chromosome 15, (d) the fusion is a MYO9A-NTRK3 fusion, wherein the fusion results from a breakpoint at 88678239-88678576 (plus or minus 10, 20, 30, 40, 50, 60, 70, 80, 90, 100, or more nucleotides) on chromosome 15 and 72373590-72373836 (plus or minus 10, 20, 30, 40, 50, 60, 70, 80, 90, 100, or more nucleotides) on chromosome 15, (e)

the fusion is a NTRK3-CDK12 fusion, wherein the fusion results from a breakpoint in intron 13 of NTRK3 and a breakpoint in intron 7 of CDK12, or wherein the fusion results from a breakpoint at chr15:88598687 (plus or minus 10, 20, 30, 40, 50, 60, 70, 80, 90, 100, or more nucleotides) and chr17:37667760 (plus or minus 10, 20, 30, 40, 50, 60, 70, 80, 90, 100, or more nucleotides), (f) the fusion is a NTRK3-EFTUD1 fusion, wherein the fusion results from a breakpoint in intron 11 of NTRK3 and a breakpoint in intron 16 of EFTUD1, or wherein the fusion results from a breakpoint at chr15:88671888 (plus or minus 10, 20, 30, 40, 50, 60, 70, 80, 90, 100, or more nucleotides) and chr15:82450990 (plus or minus 10, 20, 30, 40, 50, 60, 70, 80, 90, 100, or more nucleotides), (g) the fusion is a NTRK3-LRRK1 fusion, wherein the fusion results from a breakpoint at 88726672-88726712 (plus or minus 10, 20, 30, 40, 50, 60, 70, 80, 90, 100, or more nucleotides) on chromosome 15 and 101586177-101586217 (plus or minus 10, 20, 30, 40, 50, 60, 70, 80, 90, 100, or more nucleotides) on chromosome 15, (h) the fusion is a HMBOX1-NTRK3 fusion, wherein the fusion results from a breakpoint at chr8:28837673 (plus or minus 10, 20, 30, 40, 50, 60, 70, 80, 90, 100, or more nucleotides) and chr15:88576276 (plus or minus 10, 20, 30, 40, 50, 60, 70, 80, 90, 100, or more nucleotides), (i) the fusion is a RUNX1-NTRK3 fusion, wherein the fusion results from a breakpoint in intron 5 of RUNX1 and a breakpoint in intron 7 of NTRK3, or wherein the fusion results from a breakpoint at chr21:36245517 (plus or minus 10, 20, 30, 40, 50, 60, 70, 80, 90, 100, or more nucleotides) and chr15:88679930 (plus or minus 10, 20, 30, 40, 50, 60, 70, 80, 90, 100, or more nucleotides), (j) the fusion is a DLG1-NTRK3 fusion, wherein the fusion results from a breakpoint in intron 10 of DLG1 and a breakpoint in intron 10 of NTRK3, or wherein the fusion results from a breakpoint at chr3:196864576 (plus or minus 10, 20, 30, 40, 50, 60, 70, 80, 90, 100, or more nucleotides) and chr15:88672048 (plus or minus 10, 20, 30, 40, 50, 60, 70, 80, 90, 100, or more nucleotides), (k) the fusion is a AMMECR1-NTRK3 fusion, wherein the fusion results from a breakpoint at chr10:109507730-109507770 (plus or minus 10, 20, 30, 40, 50, 60, 70, 80, 90, 100, or more nucleotides) and chr15:88680710-88680750 (plus or minus 10, 20, 30, 40, 50, 60, 70, 80, 90, 100, or more nucleotides), (1) the fusion is a TNRC6A-NTRK3 fusion, wherein the fusion results from a breakpoint in intron 4 of TNRC6A and a breakpoint in intron 14 of NTRK3, or wherein the fusion results from a breakpoint at chr16:24787413 (plus or minus 10, 20, 30, 40, 50, 60, 70, 80, 90, 100, or more nucleotides) and chr15:88521762 (plus or minus 10, 20, 30, 40, 50, 60, 70, 80, 90, 100, or more nucleotides), (m) the fusion is a IQGAP1-NTRK3 fusion, wherein the fusion results from a breakpoint at chr15:90986710 (plus or minus 10, 20, 30, 40, 50, 60, 70, 80, 90, 100, or more nucleotides) and chr15:88670393 (plus or minus 10, 20, 30, 40, 50, 60, 70, 80, 90, 100, or more nucleotides), (n) the fusion is a RORA-NTRK3 fusion, wherein the fusion results from a breakpoint at chr15:60884583-60884623 (plus or minus 10, 20, 30, 40, 50, 60, 70, 80, 90, 100, or more nucleotides) and chr15:88423564-88423604 (plus or minus 10, 20, 30, 40, 50, 60, 70, 80, 90, 100, or more nucleotides), (o) the fusion is a CHST11-NTRK3 fusion, wherein the fusion results from a breakpoint at chr12:104995770 (plus or minus 10, 20, 30, 40, 50, 60, 70, 80, 90, 100, or more nucleotides) and chr15:88727530 (plus or minus 10, 20, 30, 40, 50, 60, 70, 80, 90, 100, or more nucleotides), (p) the fusion is a ZSCAN2-NTRK3 fusion, wherein the fusion results from a breakpoint at chr15:85147564 (plus or minus 10, 20, 30, 40, 50, 60, 70, 80, 90, 100, or more nucleotides) and chr15:88690634 (plus or minus 10, 20, 30, 40, 50, 60, 70, 80, 90, 100, or more nucleotides), (q) the fusion is a FANCI-NTRK3 fusion, wherein the fusion results from a breakpoint at chr15:89790962 (plus or minus 10, 20, 30, 40, 50, 60, 70, 80, 90, 100, or more nucleotides) and chr15:88726720 (plus or minus 10, 20, 30, 40, 50, 60, 70, 80, 90, 100, or more nucleotides), (r) the fusion is a PKM-NTRK3 fusion, wherein the fusion results from a breakpoint at chr15:72523457 (plus or minus 10, 20, 30, 40, 50, 60, 70, 80, 90, 100, or more nucleotides) and chr15:88727530 (plus or minus 10, 20, 30, 40, 50, 60, 70, 80, 90, 100, or more nucleotides), or (s) the fusion is a CARM1-NTRK3 fusion, wherein the fusion results from a breakpoint at 88799136-88799434 (plus or minus 10, 20, 30, 40, 50, 60, 70, 80, 90, 100, or more nucleotides) on Chromosome 15 and 11019501-11019751 (plus or minus 10, 20, 30, 40, 50, 60, 70, 80, 90, 100, or more nucleotides) on Chromosome 19; (ii) a nucleotide sequence of any one of SEQ ID NOs: 11 or 168-176, or a nucleotide sequence at least 70%, 75%, 80%, 85%, 90%, 91%, 92%, 93%, 94% 95%, 96%, 97%, 98%, 99%, or 99.5% identical thereto; (iii) a nucleotide sequence encoding an amino acid sequence of any one of SEQ ID NOs: 12 or 177-185, or an amino acid sequence at least 70%, 75%, 80%, 85%, 90%, 91%, 92%, 93%, 94% 95%, 96%, 97%, 98%, 99%, or 99.5% identical to any one of SEQ ID NOs: 12 or 177-185; (iv) a nucleotide sequence comprising in the 5' to 3' direction: (a) exon 14 of NTRK3 and exon 14 of ADAMTSL3, (b) exon 3 of BLM and exon 14 of NTRK3, (c) exon 7 of NTRK3 and exon 2 of ACAN, (d) exon 1 of MYO9A and exon 10 of NTRK3, (e) exons 1-13 of NTRK3 and exons 8-14 of CDK12, (f) exons 1-11 of NTRK3 and exons 17-20 of EFTUD1, (g) exons 1-5 of NTRK3 and exon 21 of LRRK1, (h) exons 1-5 of HMBOX1 and exons 14-19 of NTRK3, (i) exons 1-5 of RUNX1 and exons 8-19 of NTRK3, (j) exons 1-10 of DLG1 and exons 11-19 of NTRK3, (k) exons 1-2 of AMMECR1 and exons 6-19 of NTRK3, (1) exons 1-4 of TNRC6A and exons 15-19 of NTRK3, (m) exons 1-9 of IQGAP1 and exons 11-19 of NTRK3, (n) exon 1 of RORA and exon 18 of NTRK3, (o) exons 1-2 of CHST11 and exons 4-19 of NTRK3, (p) exons 1-2 of ZSCAN2 and exons 6-19 of NTRK3, (q) exons 1-2 of FANCI and exons 2-19 of NTRK3, (r) exon 1 of PKM and exons 4-19 of NTRK3, or (s) exon 3 of CARM1 and exon 3 of NTRK3; or (v) a fragment of any of (i)-(iv), comprising the junction between NTRK3 and a gene selected from the group consisting of ADAMTSL3, BLM, ACAN, MYO9A, CDK12, EFTUD1/EFL1, LRRK1, HMBOX1, RUNX1, DLG1, AMMECR1, TNRC6A, IQGAP1, RORA, CHST11, ZSCAN2, FANCI, PKM, and CARM1, wherein the fragment comprises between about 5 to about 300 nucleotides, between about 5 to about 25 nucleotides, between about 100 to about 300 nucleotides, between about 130 to about 230 nucleotides, or between about 150 to about 200 nucleotides.

In another aspect, provided herein is a nucleic acid molecule that is capable of hybridizing to an NTRK3 nucleic acid molecule provided herein, optionally wherein the nucleic acid molecule that is capable of hybridizing comprises between about 50 and 1000 nucleotides, between about 50 and 500 nucleotides, between about 100 and 500 nucleotides, between about 100 and 300 nucleotides, between about 130 and 230 nucleotides, between about 150 and 200 nucleotides, about 50 nucleotides, about 100 nucleotides, about 150 nucleotides, about 200 nucleotides, about 250 nucleotides, about 300 nucleotides, about 400 nucleotides, about 500 nucleotides, about 750 nucleotides, or about 1000 nucleotides. In some embodiments, the nucleic acid molecule that is capable of hybridizing is about 150 nucleotides In another aspect, provided herein is a vector comprising an NTRK1, NTRK2, or NTRK3 nucleic acid molecule provided herein.

In another aspect, provided herein is a host cell comprising a vector provided herein.

In another aspect, provided herein is an isolated fusion polypeptide encoded by an isolated NTRK1 fusion nucleic acid molecule provided herein, or a sequence at least 70%, 75%, 80%, 85%, 90%, 91%, 92%, 93%, 94% 95%, 96%, 97%, 98%, 99%, or 99.5% identical thereto. In some embodiments, the polypeptide comprises a sequence of any one of SEQ ID NOs: 81-94, or a sequence at least 70%, 75%, 80%, 85%, 90%, 91%, 92%, 93%, 94% 95%, 96%, 97%, 98%, 99%, or 99.5% identical to a sequence of any one of SEQ ID NOs: 81-94. In some embodiments, the polypeptide has a TRKA kinase activity, and/or a dimerizing or multimerizing activity.

In another aspect, provided herein is an isolated antibody molecule that specifically binds to an NTRK1 fusion polypeptide provided herein, optionally wherein the isolated antibody molecule comprises a label or a tag, e.g., a fluorescent label or tag, an affinity reagent or tag, a drug such as a cytotoxic drug.

In another aspect, provided herein is an isolated fusion polypeptide encoded by an isolated NTRK2 fusion nucleic acid provided herein, or a sequence at least 70%, 75%, 80%, 85%, 90%, 91%, 92%, 93%, 94% 95%, 96%, 97%, 98%, 99%, or 99.5% identical thereto. In some embodiments, the polypeptide comprises a sequence of any one of SEQ ID NOs: 124-129, or a sequence at least 70%, 75%, 80%, 85%, 90%, 91%, 92%, 93%, 94% 95%, 96%, 97%, 98%, 99%, or 99.5% identical to a sequence of any one of SEQ ID NOs: 124-129. In some embodiments, the polypeptide has a TRKB kinase activity, and/or a dimerizing or multimerizing activity.

In another aspect, provided herein is an isolated antibody molecule that specifically binds to an NTRK2 fusion polypeptide provided herein, optionally wherein the isolated antibody molecule comprises a label or a tag, e.g., a fluorescent label or tag, an affinity reagent or tag, a drug such as a cytotoxic drug.

In another aspect, provided herein is an isolated fusion polypeptide encoded by an isolated NTRK3 fusion nucleic acid molecule provided herein, or a sequence at least 70%, 75%, 80%, 85%, 90%, 91%, 92%, 93%, 94% 95%, 96%, 97%, 98%, 99%, or 99.5% identical thereto. In some embodiments, the polypeptide comprises a sequence of any one of SEQ ID NOs: 12 or 177-185, or a sequence at least 70%, 75%, 80%, 85%, 90%, 91%, 92%, 93%, 94% 95%, 96%, 97%, 98%, 99%, or 99.5% identical to a sequence of any one of SEQ ID NOs: 12 or 177-185. In some embodiments, the polypeptide has a TRKC kinase activity, and/or a dimerizing or multimerizing activity.

In another aspect, provided herein is an isolated antibody molecule that specifically binds to an NTRK3 fusion polypeptide provided herein, optionally wherein the isolated antibody molecule comprises a label or a tag, e.g., a fluorescent label or tag, an affinity reagent or tag, a drug such as a cytotoxic drug.

In another aspect, provided herein is a preparation of a nucleic acid molecule provided herein, e.g., an NTRK1, NTRK2, or NTRK2 fusion nucleic acid molecule provided herein, disposed in a sequencing device, or a sample holder for use in such a device.

In another aspect, provided herein is a preparation of a nucleic acid molecule provided herein, e.g., an NTRK1, NTRK2, or NTRK2 fusion nucleic acid molecule provided herein, disposed in a device for determining a physical or chemical property, e.g., stability of a duplex, e.g., $T_m$, or a sample holder for use in such a device.

In another aspect, provided herein is a detection reagent comprising a DNA, RNA, or mixed DNA/RNA molecule, comprising a nucleotide sequence that is complementary to a nucleotide sequence of a nucleic acid molecule provided herein, e.g., an NTRK1, NTRK2, or NTRK2 fusion nucleic acid molecule provided herein.

In another aspect, provided herein is a kit comprising a detection reagent provided herein and instructions for use of the detection reagent to detect a nucleic acid molecule provided herein, e.g., an NTRK1, NTRK2, or NTRK2 fusion nucleic acid molecule provided herein.

In another aspect, provided herein is a kit comprising: an antibody molecule provided herein and instructions for use of the antibody molecule to detect a fusion polypeptide provided herein, e.g., an NTRK1, NTRK2, or NTRK3 fusion polypeptide provided herein.

In another aspect, provided herein is a method of reducing an activity or expression of a fusion polypeptide, comprising, optionally, acquiring knowledge of the presence of a fusion polypeptide provided herein, e.g., an NTRK1, NTRK2, or NTRK3 fusion polypeptide provided herein; and contacting the fusion polypeptide or a cell expressing the fusion polypeptide with an agent that reduces an activity or expression of the fusion polypeptide. In some embodiments, the contacting step is effected in vitro. In some embodiments, the contacting step is effected in vivo. In some embodiments, the contacting step is effected in a human or animal subject.

In another aspect, provided herein is a therapeutic agent for use in treating a disease in a subject, wherein the use comprises acquiring knowledge of the presence of a fusion nucleic acid molecule provided herein, e.g., an NTRK1, NTRK2, or NTRK2 fusion nucleic acid molecule provided herein, or a fusion polypeptide provided herein, e.g., an NTRK1, NTRK2, or NTRK2 fusion polypeptide provided herein, in the subject. In some embodiments, the therapeutic agent is administered after knowledge of the presence of the fusion nucleic acid molecule or the fusion polypeptide is acquired.

In some embodiments, the diseases is a genetic disorder, multifactorial disorder, metabolic disorder, a disease characterized by or associated with an NTRK1, NTRK2, or NTRK3 fusion provided herein, an immune disorder, an inflammatory disorder, or an autoimmune disorder.

In some embodiments, the disease is cancer. In some embodiments, the cancer is selected from the group consisting of acute myeloid leukemia (AML), acute lymphoblastic leukemia (ALL), adenocarcinoma, adenocarcinoma of the lung, adrenocortical carcinoma, anal cancer, squamous cell carcinoma of the anus, appendiceal cancer, B-cell derived leukemia, B-cell derived lymphoma, bladder cancer, brain cancer, breast cancer, triple negative breast cancer (TNBC), non-triple negative breast cancer, cancer of the fallopian tubes, cancer of the testes, cerebral cancer, cervical cancer, squamous cell carcinoma of the cervix, cholangiocarcinoma, choriocarcinoma, chronic myelogenous leukemia, a CNS tumor, colon adenocarcinoma, colon cancer, colorectal cancer, colon adenocarcinoma, diffuse intrinsic pontine glioma (DIPG), diffuse large B cell lymphoma (DLBCL), embryonal rhabdomyosarcoma (ERMS), endometrial cancer, epithelial cancer, esophageal cancer, squamous cell carcinoma of the esophagus, Ewing's sarcoma, eye cancer, uveal melanoma, follicular lymphoma, gall bladder cancer, gastric cancer, gastrointestinal cancer, glioblastoma multiforme, glioma, lower grade glioma, head and neck cancer, squamous cell carcinoma of the head and neck (SCHNC), a hematological cancer, hepatocellular cancer, Hodgkin's lymphoma (HL), primary mediastinal B-cell lymphoma, kidney cancer, kidney clear cell cancer, kidney papillary cancer, kidney chromophobe cancer, large B-cell lymphoma, laryngeal cancer, leukemia, liver cancer, lung cancer, non-small cell lung cancer (NSCLC), small cell lung cancer, lung adenocarcinoma, squamous cell carcinoma of the lung, lymphoma, melanoma, Merkel cell carcinoma, mesothelioma, monocytic leukemia, multiple myeloma, myeloma, a neuroblastic-derived CNS tumor, neuroblastoma (NB), non-Hodgkin's lymphoma (NHL), non-small cell lung cancer (NSCLC), oral cancer, osteosarcoma, ovarian cancer, ovarian carcinoma, pancreatic cancer, peritoneal cancer, pheocromocytoma, primary peritoneal cancer, prostate cancer, relapsed or refractory classic Hodgkin's Lymphoma (cHL), renal cancer, renal cell carcinoma, rectal cancer, rectum carcinoma, salivary gland cancer, salivary gland tumor, sarcoma, skin cancer, small cell lung cancer, small intestine cancer, squamous cell carcinoma of the penis, soft tissue sarcoma, squamous cell carcinoma of the esophagus, squamous cell carcinoma of the head and neck (SCHNC), squamous cell carcinoma of the lung, stomach cancer, T-cell derived leukemia, T-cell derived lymphoma, testicular tumor, thymic cancer, a thymoma, thyroid cancer, thyroid carcinoma, uveal melanoma, urothelial cell carcinoma, uterine cancer, uterine endometrial cancer, uterine sarcoma, uterine carcinosarcoma, vaginal cancer, squamous cell carcinoma of the vagina, vulvar cancer, squamous cell carcinoma of the vulva, and Wilms tumor. In some embodiments, the cancer is selected from the group consisting of melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma. In some embodiments, the cancer is selected from the group consisting of ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, and a brain medulloblastoma. In some embodiments, the cancer is selected from the group consisting of a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, and a colon adenocarcinoma.

In some embodiments, the therapeutic agent is an anticancer agent. In some embodiments, the therapeutic agent is a kinase inhibitor. In some embodiments, the kinase inhibitor is is selected from the group consisting of AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo [1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928. In some embodiments, the kinase inhibitor is larotrectinib, AZ-23, danusertib (PHA-739358), entrectinib, lestaurtinib (CEP-701), AZD7451, belizatinib, selitrectinib, or crizotinib.

In another aspect, provided herein is a method for screening for an agent that inhibits the expression or activity of a fusion polypeptide provided herein, e.g., an NTRK1, NTRK2, or NTRK3 fusion polypeptide provided herein, comprising: optionally, determining if the fusion polypeptide or a nucleic acid molecule encoding the fusion polypeptide is present; contacting the fusion polypeptide, e.g., an NTRK1, NTRK2, or NTRK3 fusion polypeptide provided herein, or a host cell expressing the fusion polypeptide, e.g., an NTRK1, NTRK2, or NTRK3 fusion polypeptide provided herein, with a candidate agent; and detecting a change in a parameter associated with the fusion polypeptide. In some embodiments, a parameter is (i) a change in binding activity, e.g., direct binding of a candidate agent to a fusion polypeptide described herein; a binding competition between a known ligand and the candidate agent to a fusion polypeptide described herein; (ii) a change in kinase activity, e.g., phosphorylation levels of a fusion polypeptide described herein (e.g., an increased or decreased autophosphorylation of the fusion polypeptide); or a change in phosphorylation of a target of the kinase; (iii) a change in an activity of a cell containing a fusion molecule described herein (e.g., a tumor cell or a recombinant cell), e.g., a change in proliferation, morphology or tumorigenicity of the cell; (iv) a change in a tumor present in an animal subject, e.g., size, appearance, or proliferation, of the tumor; or (v) a change in the level, e.g., expression level, of a fusion polypeptide described herein or a nucleic acid molecule described herein.

In another aspect, provided herein is a method of detecting the presence of a fusion nucleic acid molecule or of a fusion polypeptide, comprising: (a) detecting a fusion nucleic acid molecule provided herein, e.g., an NTRK1, NTRK2, or NTRK3 fusion nucleic acid molecule; or (b) detecting a fusion polypeptide provided herein, e.g., an NTRK1, NTRK2, or NTRK3 fusion polypeptide, in a sample. In some embodiments, said sample comprises fluid, cells, or tissue. In some embodiments, the sample comprises a tumor biopsy, a circulating tumor cell, or a circulating tumor nucleic acid. In some embodiments, the sample is acquired from a subject. In some embodiments, the sample is a nucleic acid sample e.g., a sample comprising cell-free DNA (cfDNA) or circulating tumor DNA (ctDNA). In some embodiments, the fusion nucleic acid molecule is detected in the sample by one or more methods selected from the group consisting of a nucleic acid hybridization assay, an amplification-based assay, a PCR-RFLP assay, real-time PCR, sequencing, a screening analysis, FISH, spectral karyotyping or MFISH, comparative genomic hybridization, in situ hybridization, sequence-specific priming (SSP) PCR, HPLC, and mass-spectrometric genotyping. In some embodiments, the sample is a protein sample. In some embodiments, the fusion polypeptide is detected in the sample by contacting the sample with a reagent which specifically binds to a fusion polypeptide provided herein, e.g., an NTRK1, NTRK2, or NTRK3 fusion polypeptide provided herein, and detecting the formation of a complex of the fusion polypeptide and the reagent.

In another aspect, provided herein is a method of evaluating a subject, comprising: identifying, selecting, or obtaining information or knowledge that the subject has participated in a clinical trial or has been treated for a disease; and acquiring genotype information that identifies a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in the subject, wherein the presence of the fusion nucleic acid molecule or of the fusion polypeptide identifies the subject as having a disease associated with the fusion nucleic acid molecule or the fusion polypeptide, or having an increased risk of recurrence for the disease. In some embodiments, the presence of the fusion nucleic acid molecule or of the fusion polypeptide identifies the subject as a subject who may benefit from continuing a treatment for the disease. In some embodiments, the presence of the fusion nucleic acid molecule or of the fusion polypeptide identifies the subject as a subject who may benefit from initiating a treatment for the disease. In some embodiments, the method further comprises monitoring the subject to determine the length of treatment, e.g., how long the subject is administered the treatment for the disease; or monitoring the subject for recurrence of the disease, and optionally, the need to resume treatment for the disease. In some embodiments, the disease is cancer, e.g., a cancer provided herein. In some embodiments, the method further comprises administering an anti-cancer agent to the subject, e.g., an anti-cancer agent provided herein.

In another aspect, provided herein is a method for generating a personalized treatment report, comprising: obtaining a sample from a subject, detecting a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in the sample; and providing a report comprising information on the fusion nucleic acid molecule or the fusion polypeptide detected and treatment options. In some embodiments, the report is provided to a physician. In some embodiments, the physician selects a treatment for the subject. In some embodiments, a report comprising information on the fusion nucleic acid molecule or the fusion polypeptide detected and the treatment selected is provided to the subject. In some embodiments, the subject has cancer, e.g., a cancer provided herein.

In another aspect, provided herein is a method for generating a personalized cancer treatment report, comprising: obtaining a sample from a subject, detecting a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in the sample; selecting a treatment based on the fusion nucleic acid molecule or the fusion polypeptide detected; and providing a report comprising information on the fusion nucleic acid molecule or the fusion polypeptide detected and the treatment selected. In some embodiments, a physician selected a treatment based on the fusion nucleic acid molecule or the fusion polypeptide detected. In some embodiments, the report comprising information on the fusion nucleic acid molecule or the fusion polypeptide detected and the treatment selected is provided to the subject.

In another aspect, provided herein is a method of identifying an individual having cancer or at risk of having cancer who may benefit from a treatment comprising an anti-cancer agent, the method comprising detecting a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from the individual; wherein the presence of the fusion nucleic acid molecule or of the fusion polypeptide in the sample identifies the individual as one who may benefit from the treatment comprising an anti-cancer agent.

In another aspect, provided herein is a method of selecting a therapy for an individual having cancer or at risk of having cancer, the method comprising detecting a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from the individual; wherein the presence of the fusion nucleic acid molecule or of the fusion polypeptide in the sample identifies the individual as one who may benefit from a treatment comprising an anti-cancer agent.

In another aspect, provided herein is a method of identifying one or more treatment options for an individual having cancer or at risk of having cancer, the method comprising: (a) detecting a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from the individual; and (b) generating a report comprising one or more treatment options identified for the individual based at least in part on the presence of the fusion nucleic acid molecule or of the fusion polypeptide in the sample, wherein the one or more treatment options comprise a treatment comprising an anti-cancer agent.

In another aspect, provided herein is a method of identifying one or more treatment options for an individual having cancer or at risk of having cancer, the method comprising: (a) acquiring knowledge of a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from the individual; and (b) generating a report comprising one or more treatment options identified for the individual based at least in part on said knowledge, wherein the one or more treatment options comprise a treatment comprising an anti-cancer agent.

In another aspect, provided herein is a method of selecting a treatment for a subject having cancer or at risk of having cancer, comprising acquiring knowledge of a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from a subject having cancer; wherein responsive to the acquisition of said knowledge: (i) the subject is classified as a candidate to receive a treatment comprising an anti-cancer agent; and/or (ii) the subject is identified as likely to respond to a treatment comprising an anti-cancer agent.

In another aspect, provided herein is a method of treating or delaying progression of cancer, comprising administering to an individual an effective amount of a treatment comprising an anti-cancer agent, wherein the cancer comprises a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein.

In another aspect, provided herein is a method of treating or delaying progression of cancer, comprising, responsive to knowledge of a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from an individual, administering to the individual an effective amount of a treatment comprising an anti-cancer agent.

In another aspect, provided herein is a method of treating or delaying progression of cancer, comprising: (a) detecting a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from an individual; and (b) administering to the individual an effective amount of a treatment comprising an anti-cancer agent.

In some embodiments, the methods provided herein further comprise administering an effective amount of an anti-cancer agent to the subject.

In another aspect, provided herein is a method of treating or delaying progression of cancer, comprising: (a) acquiring knowledge of a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from an individual; and (b) responsive to said knowledge, administering to the individual an effective amount of a treatment comprising an anti-cancer agent.

In some embodiments, wherein the fusion nucleic acid molecule is an NTRK3 fusion nucleic acid molecule provided herein, or the fusion polypeptide is an NTRK3 fusion polypeptide provided herein, and wherein the cancer is selected from the group consisting of melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma.

In some embodiments, the fusion nucleic acid molecule is an NTRK1 fusion nucleic acid molecule provided herein, or the fusion polypeptide is an NTRK1 fusion polypeptide provided herein and wherein the cancer is selected from the group consisting of an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, and a brain medulloblastoma.

In some embodiments, the fusion nucleic acid molecule is an NTRK2 fusion nucleic acid molecule provided herein, or the fusion polypeptide is an NTRK2 fusion polypeptide provided herein, and wherein the cancer is selected from the group consisting of a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, and a colon adenocarcinoma.

In some embodiments, the cancer is a colorectal cancer, and the colorectal cancer comprises high microsatellite instability (MSI). In some embodiments, the cancer does not have an alteration in one or more of ALK, BRAF, ERBB2, EGFR, ROS1, or KRAS. In some embodiments, the cancer has no detectable altered level or activity of one or more of EGFR, KRAS, ALK, ROS1 or RET. In some embodiments, the cancer comprises a tumor mutation burden (TMB) of 5 mut/Mb or more, optionally wherein the cancer comprises a TMB of 6-19 Muts/Mb, or optionally wherein the cancer comprises a TMB of 20 mut/Mb or more. In some embodiments, the cancer is selected from the group consisting of acute myeloid leukemia (AML), acute lymphoblastic leukemia (ALL), adenocarcinoma, adenocarcinoma of the lung, adrenocortical carcinoma, anal cancer, squamous cell carcinoma of the anus, appendiceal cancer, B-cell derived leukemia, B-cell derived lymphoma, bladder cancer, brain cancer, breast cancer, triple negative breast cancer (TNBC), non-triple negative breast cancer, cancer of the fallopian tubes, cancer of the testes, cerebral cancer, cervical cancer, squamous cell carcinoma of the cervix, cholangiocarcinoma, choriocarcinoma, chronic myelogenous leukemia, a CNS tumor, colon adenocarcinoma, colon cancer, colorectal cancer, colon adenocarcinoma, diffuse intrinsic pontine glioma (DIPG), diffuse large B cell lymphoma (DLBCL), embryonal rhabdomyosarcoma (ERMS), endometrial cancer, epithelial cancer, esophageal cancer, squamous cell carcinoma of the esophagus, Ewing's sarcoma, eye cancer, uveal melanoma, follicular lymphoma, gall bladder cancer, gastric cancer, gastrointestinal cancer, glioblastoma multiforme, glioma, lower grade glioma, head and neck cancer, squamous cell carcinoma of the head and neck (SCHNC), a hematological cancer, hepatocellular cancer, Hodgkin's lymphoma (HL), primary mediastinal B-cell lymphoma, kidney cancer, kidney clear cell cancer, kidney papillary cancer, kidney chromophobe cancer, large B-cell lymphoma, laryngeal cancer, leukemia, liver cancer, lung cancer, non-small cell lung cancer (NSCLC), small cell lung cancer, lung adenocarcinoma, squamous cell carcinoma of the lung, lymphoma, melanoma, Merkel cell carcinoma, mesothelioma, monocytic leukemia, multiple myeloma, myeloma, a neuroblastic-derived CNS tumor, neuroblastoma (NB), non-Hodgkin's lymphoma (NHL), non-small cell lung cancer (NSCLC), oral cancer, osteosarcoma, ovarian cancer, ovarian carcinoma, pancreatic cancer, peritoneal cancer, pheocromocytoma, primary peritoneal cancer, prostate cancer, relapsed or refractory classic Hodgkin's Lymphoma (cHL), renal cancer, renal cell carcinoma, rectal cancer, rectum carcinoma, salivary gland cancer, salivary gland tumor, sarcoma, skin cancer, small cell lung cancer, small intestine cancer, squamous cell carcinoma of the penis, soft tissue sarcoma, squamous cell carcinoma of the esophagus, squamous cell carcinoma of the head and neck (SCHNC), squamous cell carcinoma of the lung, stomach cancer, T-cell derived leukemia, T-cell derived lymphoma, testicular tumor, thymic cancer, a thymoma, thyroid cancer, thyroid carcinoma, uveal melanoma, urothelial cell carcinoma, uterine cancer, uterine endometrial cancer, uterine sarcoma, uterine carcinosarcoma, vaginal cancer, squamous cell carcinoma of the vagina, vulvar cancer, squamous cell carcinoma of the vulva, and Wilms tumor.

In some embodiments, the anti-cancer agent is a kinase inhibitor. In some embodiments, the kinase inhibitor is selected from the group consisting of AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo [2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928. In some embodiments, the kinase inhibitor is larotrectinib, AZ-23, danusertib (PHA-739358), entrectinib, lestaurtinib (CEP-701), AZD7451, belizatinib, selitrectinib, or crizotinib. In some embodiments, the kinase inhibitor is selected from the group consisting of an antisense molecule, a ribozyme, an siRNA, a triple helix-forming oligonucleotide, and a gRNA. In some embodiments, the anti-cancer agent or the kinase inhibitor further comprises a second therapeutic agent. In some embodiments, the fusion nucleic acid molecule is an NTRK1 fusion nucleic acid molecule provided herein, or the fusion polypeptide is an NTRK1 fusion polypeptide provided herein, wherein the anti-cancer agent or the kinase inhibitor further comprises an HSP90 inhibitor. In some embodiments, the HSP90 inhibitor comprises a benzoquinone HSP90 inhibitor or a hygroquinone ansamycin HSP90 inhibitor. In some embodiments, the HSP90 inhibitor comprises one or more of 17-AAG, 17-DMAG, AT-13387, AUY-922, BIIB-021 (CNF-2024), BIIB-028, CCT-018159, CCT-129397, CNF-1010, CU-0305, Geldanamycin, IPI-504, Macbecin I, Macbecin II, MPC-3100, PF-04928473 (SNX-2112), Pochonin, PU-H71, Radanamycin, Radicol, SanA, di-SanA, SNX-5422, STA-9090, or XL-888. In some embodiments, the second therapeutic agent is selected from the group consisting of a chemotherapeutic agent, an antihormonal agent, an antimetabolite chemotherapeutic agent, a kinase inhibitor, a methyltransferase inhibitor, a peptide, a gene therapy, a vaccine, a platinum-based chemotherapeutic agent, an immunotherapy, an antibody, and a checkpoint inhibitor. In some embodiments, the immunotherapy or the checkpoint inhibitor targets PD-L1, PD-1, CTLA-4, CEACAM, LAIR1, CD160, 2B4, CD80, CD86, CD276, VTCN1, HVEM, KIR, A2AR, MHC class I, MHC class II, GALS, adenosine, TGFR, OX40, CD137, CD40, IDO, CSF1R, TIM-3, BTLA, VISTA, LAG-3, TIGIT, IDO, MICA/B, or arginase.

In another aspect, provided herein is a method of assessing an NTRK1, NTRK2, or NTRK3 gene fusion in an individual, the method comprising detecting a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, in a sample from the individual; and providing an assessment of the fusion nucleic acid molecule or of the fusion polypeptide in the sample.

In another aspect, provided herein is an anti-cancer agent for use in a method of treating or delaying progression of cancer, wherein the method comprises administering the kinase inhibitor to an individual, wherein a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, is detected in a sample obtained from the individual.

In another aspect, provided herein, is an anti-cancer agent for use in the manufacture of a medicament for treating or delaying progression of cancer, wherein the medicament is to be administered to an individual, wherein a fusion nucleic acid molecule provided herein, e.g., an NTRK1, NTRK2, or NTRK3 fusion nucleic acid molecule provided herein, or a fusion polypeptide provided herein, e.g., an NTRK1, NTRK2, or NTRK3 fusion polypeptide provided herein, has been detected in a sample obtained from the individual.

In some embodiments, the anti-cancer agent is a kinase inhibitor. In some embodiments, the kinase inhibitor is selected from the group consisting of AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo [2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928. In some embodiments, the kinase inhibitor is larotrectinib, AZ-23, danusertib (PHA-739358), entrectinib, lestaurtinib (CEP-701), AZD7451, belizatinib, selitrectinib, or crizotinib. In some embodiments, the anti-cancer agent is selected from the group consisting of a chemotherapeutic agent, an anti-hormonal agent, an antimetabolite chemotherapeutic agent, a kinase inhibitor, a methyltransferase inhibitor, a peptide, a gene therapy, a vaccine, a platinum-based chemotherapeutic agent, an immunotherapy, an antibody, and a checkpoint inhibitor. In some embodiments, the immunotherapy or the checkpoint inhibitor targets PD-L1, PD-1, CTLA-4, CEACAM, LAIR1, CD160, 2B4, CD80, CD86, CD276, VTCN1, HVEM, KIR, A2AR, MHC class I, MHC class II, GALS, adenosine, TGFR, OX40, CD137, CD40, IDO, CSF1R, TIM-3, BTLA, VISTA, LAG-3, TIGIT, IDO, MICA/B, or arginase.

In another aspect, provided herein is an in vitro use of one or more oligonucleotides for detecting a fusion nucleic acid molecule provided herein, e.g., an NTRK1, NTRK2, or NTRK3 fusion nucleic acid molecule provided herein.

In another aspect, provided herein is a kit comprising one or more oligonucleotides for detecting a fusion nucleic acid molecule provided herein, e.g., an NTRK1, NTRK2, or NTRK3 fusion nucleic acid molecule provided herein.

In some embodiments of the methods provided herein, the methods further comprise providing a report to a party. In some embodiments, the party is the subject, a caregiver, a physician, an oncologist, a hospital, a clinic, a third-party payor, an insurance company or a government office. In some embodiments, said report is in electronic, web-based, or paper form. In some embodiments, said paper form is a facsimile. In some embodiments, said report is in the form of a facsimile. In some embodiments, the report identifies the presence or absence of the fusion nucleic acid molecule or the fusion polypeptide, and optionally comprises an identifier for the subject from which the fusion nucleic acid molecule or the fusion polypeptide was obtained. In some embodiments, said report comprises; information on the role of the fusion nucleic acid molecule or the fusion polypeptide in disease; information on prognosis, resistance, or potential or suggested therapeutic options; information on the likely effectiveness of a therapeutic option, the acceptability of a therapeutic option, or the advisability of applying the therapeutic option to a subject; or information, or a recommendation on the administration of a drug.

In some embodiments, which may be combined with any of the preceding aspects or embodiments, the anti-cancer agent or the kinase inhibitor is larotrectinib, entrectinib, or selitrectinib. In some embodiments, the anti-cancer agent or the kinase inhibitor is larotrectinib. In some embodiments, the anti-cancer agent or the kinase inhibitor is entrectinib. In some embodiments, the anti-cancer agent or the kinase inhibitor is selitrectinib.

Each of these fusion molecules is described herein in more detail.

MEX3A-NTRK1 Fusions

Disclosed herein are fusion molecules that comprise all or part of MEX3A and all or part of NTRK1. A MEX3A-NTRK1 fusion molecule described herein includes any fusion molecule (e.g., gene, gene product (e.g., cDNA, mRNA, or polypeptide), and variant thereof) that includes a fragment of a MEX3A gene or gene product and a fragment of an NTRK1 gene or gene product described herein, including, e.g., a MEX3A-NTRK1 fusion molecule as summarized in FIGS. 1A-1C. Expression of the fusion molecules was detected in cancer tissues, thus suggesting an association with cancer, e.g., an ovarian cancer, e.g., an ovarian carcinosarcoma.

In one embodiment, the MEX3A-NTRK1 fusion molecule includes an in-frame fusion of an exon of MEX3A, e.g., one more exons of MEX3A (e.g., exon 1 of MEX3A of FIG. 2 (SEQ ID NO: 1)) or a fragment thereof, and an exon of NTRK1, e.g., one or more exons of an NTRK1 (e.g., one, two, three, four, five, six, seven, eight, or more of exons 9-17 of NTRK1 of FIG. 4 (SEQ ID NO: 3)) or a fragment thereof. In another embodiment, the fusion molecule includes the nucleotide sequence of SEQ ID NO: 5 (FIG. 6) or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion molecule encodes the amino acid sequence of SEQ ID NO: 6 (FIG. 7), or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

For example, the MEX3A-NTRK1 fusion molecule can include an in-frame fusion within an intron of MEX3A (e.g., intron 1) or a fragment thereof, with an intron of NTRK1 (e.g., intron 8) or a fragment thereof. In one embodiment, the MEX3A-NTRK1 fusion comprises the nucleotide sequence of: chromosome 1 at nucleotide 156,051,070 (plus or minus 10, 20, 30, 40, 50, 60, 70, 80, 90, 100, or more nucleotides) to nucleotide 156,051,319 (plus or minus 10, 20, 30, 40, 50, 60, 70, 80, 90, 100, or more nucleotides) and nucleotide 156,843,777 (plus or minus 10, 20, 30, 40, 50, 60, 70, 80, 90, 100, or more nucleotides) to nucleotide 156,843,890 (plus or minus 10, 20, 30, 40, 50, 60, 70, 80, 90, 100, or more nucleotides). In one embodiment, the nucleotide sequence flanking the breakpoint of MEX3A comprises the nucleotide sequence of SEQ ID NO: 14 (FIG. 13) or a fragment thereof. In one embodiment, the nucleotide sequence flanking the breakpoint of NTRK1 comprises the nucleotide sequence of SEQ ID NO: 15 (FIG. 14) or a fragment thereof. In one embodiment, the MEX3A-NTRK1 fusion is an inversion, e.g., an inversion of chromosome 1. In certain embodiments, the MEX3A-NTRK1 fusion polypeptide is in a 5'-MEX3A to 3'-NTRK1 configuration (also referred to herein as "5'-MEX3A-NTRK1-3'"). The term "fusion" or "fusion molecule" can refer to a fusion polypeptide or a fusion nucleic acid/fusion nucleic acid molecule, depending on the context. It may include a full-length sequence of a fusion or a fragment thereof, e.g., a fragment comprising a fusion junction (e.g., a fragment including a portion of MEX3A and a portion of NTRK1, e.g., a portion of the MEX3A-NTRK1 fusion molecule described herein). In one embodiment, the MEX3A-NTRK1 fusion polypeptide includes a fragment of the amino acid sequence shown in FIG. 3 (SEQ ID NO: 2) and a fragment of the amino acid sequence shown in FIG. 5 (SEQ ID NO: 4), or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the MEX3A-NTRK1 fusion polypeptide includes the amino acid sequence of SEQ ID NO: 6 shown in FIG. 7, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In another embodiment, the MEX3A-NTRK1 fusion nucleic acid molecule includes a fragment of the nucleotide sequence shown in FIG. 2 (SEQ ID NO: 1) and a fragment of the nucleotide sequence shown in FIG. 4 (SEQ ID NO: 3), or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes the nucleotide sequence of SEQ ID NO: 5 (FIG. 6) or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion nucleic acid molecule includes a nucleotide sequence encoding the amino acid sequence of SEQ ID NO: 6 (FIG. 7), or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the MEX3A-NTRK1 fusion polypeptide comprises sufficient MEX3A sequence and sufficient NTRK1 sequence such that the 5'-MEX3A-NTRK1-3' fusion has a kinase activity, e.g., has an elevated (e.g., constitutive) activity, e.g., an NTRK1 tyrosine kinase activity, as compared with wildtype NTRK1, e.g., in a cell of a cancer described to herein (e.g., an ovarian cancer, e.g., an ovarian carcinosarcoma).

In certain embodiments, the MEX3A-NTRK1 fusion comprises exon 1 (or the corresponding amino acid sequence encoded by exon 1) from MEX3A of SEQ ID NO: 1 or 2 (FIG. 2 or 3, respectively), and one or more of (e.g., all of) exons 9-17 (or the corresponding amino acid sequence encoded by exons 9-17) of NTRK1 of SEQ ID NO: 3 or 4 (FIG. 4 or 5, respectively). In certain embodiments, the MEX3A-NTRK1 fusion comprises at least 1 or more exons (or encoded exons) from MEX3A and at least 1, 2, 3, 4, 5, 6, 7, 8, or more exons (or encoded exons) from NTRK1 (e.g., from the MEX3A and NTRK1 nucleotide sequences shown in FIG. 2 and FIG. 4 (SEQ ID NOs: 1 and 3) or the amino acid sequences shown in FIG. 3 and FIG. 5 (SEQ ID NOs: 2 and 4)). In certain embodiments, the MEX3A-NTRK1 fusion comprises encoded exon 1 of MEX3A and encoded exons 9-17 of NTRK1.

In one embodiment, the MEX3A-NTRK1 fusion comprises at least 5, 10, 15, 20, 25, 30, 40, 50, or more amino acids from exon 1 of MEX3A (e.g., from the amino acid sequence of MEX3A as shown in FIG. 3 (SEQ ID NO: 2)) (e.g., from the amino acid sequence of MEX3A preceding the fusion junction with NTRK1), and at least 5, 10, 15, 20, 25, 30, 40, 50, or more amino acids from one, two, three, four, five, six, seven, eight, or more of exons 9-17 of NTRK1 (e.g., from the amino acid sequence of NTRK1 as shown in FIG. 5 (SEQ ID NO: 4)) (e.g., from the amino acid sequence of NTRK1 following the fusion junction with MEX3A). In another embodiment, the MEX3A-NTRK1 fusion comprises at least 6, 12, 15, 20, 25, 50, 75, 100, or more nucleotides from exon 1 of MEX3A (e.g., from the nucleotide sequence of MEX3A as shown in FIG. 2 (SEQ ID NO: 1) (e.g., from the nucleotide sequence of MEX3A preceding the fusion junction with NTRK1); and at least 6, 12, 15, 20, 25, 50, 75, 100, or more nucleotides from one, two, three, four, five, six, seven, eight, or more of exons 9-17 of NTRK1 (e.g., from the nucleotide sequence of NTRK1 as shown in FIG. 4 (SEQ ID NO: 3)).

MEX3A-NTRK1 Fusion Nucleic Acid Molecules

In one aspect, the disclosure features a nucleic acid molecule (e.g., an isolated or purified nucleic acid molecule) that includes a fragment of a MEX3A gene and a fragment of an NTRK1 gene. In one embodiment, the fusion nucleic acid molecule includes a nucleotide sequence encoding a MEX3A-NTRK1 fusion polypeptide that includes an NTRK1 tyrosine kinase domain or a functional fragment thereof. In other embodiments, the fusion nucleic acid molecule includes a nucleotide sequence encoding a fragment of the MEX3A polypeptide including the amino acid sequence of SEQ ID NO: 2 or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes a nucleotide sequence encoding a fragment of the NTRK1 polypeptide including the amino acid sequence of SEQ ID NO: 4 or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding the amino acid sequence shown in FIG. 3 (SEQ ID NO: 2), or a fragment thereof, and the amino acid sequence shown in FIG. 5 (SEQ ID NO: 4) or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding the amino acid sequence shown in FIG. 7 (SEQ ID NO: 6), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the MEX3A-NTRK1 nucleic acid molecule includes a fusion, e.g., resulting in an in-frame fusion, between an intron of MEX3A (e.g., intron 1, or a fragment thereof) and an intron of NTRK1 (e.g., intron 8, or a fragment thereof). The MEX3A-NTRK1 fusion nucleic acid molecule can comprise a fusion of the nucleotide sequence of: chromosome 1 at nucleotide 156,051,070 (plus or minus 10, 20, 30, 40, 50, 60, 70, 80, 90, 100, or more nucleotides) to nucleotide 156,051,319 (plus or minus 10, 20, 30, 40, 50, 60, 70, 80, 90, 100, or more nucleotides) and nucleotide 156,843, 777 (plus or minus 10, 20, 30, 40, 50, 60, 70, 80, 90, 100, or more nucleotides) to nucleotide 156,843,890 (plus or minus 10, 20, 30, 40, 50, 60, 70, 80, 90, 100, or more nucleotides).

In another embodiment, the MEX3A-NTRK1 fusion nucleic acid molecule comprises a nucleotide sequence (e.g., a fragment of a nucleotide sequence) shown in FIG. 2 (SEQ ID NO: 1) and a nucleotide sequence (e.g., a fragment of a nucleotide sequence) shown in FIG. 4 (SEQ ID NO: 3), or a fragment of the fusion nucleic acid molecule. In one embodiment, the MEX3A-NTRK1 fusion nucleic acid molecule comprises a nucleotide sequence substantially identical to the nucleotide sequence (e.g., a fragment of a nucleotide sequence) shown in FIG. 2 (SEQ ID NO: 1) and the nucleotide sequence (e.g., a fragment of a nucleotide sequence) shown FIG. 4 (SEQ ID NO: 3), or a fragment of the fusion. In another embodiment, the MEX3A-NTRK1 fusion nucleic acid molecule comprises a nucleotide sequence (e.g., a fragment of a nucleotide sequence) shown in FIG. 6 (SEQ ID NO: 5), or a fragment of the fusion. In one embodiment, the MEX3A-NTRK1 fusion nucleic acid molecule comprises a nucleotide sequence substantially identical to the nucleotide sequence (e.g., a fragment of a nucleotide sequence) shown in FIG. 6 (SEQ ID NO: 5), or a fragment of the fusion.

In one embodiment, the MEX3A-NTRK1 fusion nucleic acid molecule comprises a nucleotide sequence at least 70%, 75%, 80%, 85%, 90%, 91%, 92%, 93%, 94%, 95%, 96%, 97%, 98%, 99%, or 99.5% identical to the nucleotide sequence (e.g., a fragment of a nucleotide sequence) shown in FIG. 2 (SEQ ID NO: 1) and to the nucleotide sequence (e.g., a fragment of a nucleotide sequence) shown in FIG. 4 (SEQ ID NO: 3). In yet other embodiments, the MEX3A-NTRK1 fusion nucleic acid molecule comprises the nucleotide sequence of SEQ ID NO: 5 (FIG. 6), or a fragment thereof, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical to the nucleotide sequence, or a fragment of a nucleotide sequence). In one embodiment, the MEX3A-NTRK1 fusion nucleic acid molecule comprises a nucleotide sequence containing at least 25, 50, 100, 150, 200, 500, 1000, 1500, 2000, 2500, 3000, 4000, 5000, 6000, or more nucleotides of the nucleotide sequence shown in FIG. 2 (SEQ ID NO: 1) and a nucleotide sequence containing at least 25, 50, 100, 150, 200, 500, 1000, 1500, 2000, 2500, or more nucleotides of the nucleotide sequence shown in FIG. 4 (SEQ ID NO: 3). In one embodiment, the MEX3A-NTRK1 fusion nucleic acid molecule comprises a nucleotide sequence containing at least 25, 50, 100, 150, 200, 500, 1000, 1500, 2000, 2500, 3000, 4000, 5000, 6000, or more nucleotides (e.g., contiguous nucleotides) of the nucleotide sequence shown in FIG. 2 (SEQ ID NO: 1) and a nucleotide sequence containing at least 25, 50, 100, 150, 200, 500, 1000, 1500, 2000, 2500, or more nucleotides of the nucleotide sequence shown in FIG. 4 (SEQ ID NO: 3).

In another embodiment, the nucleic acid molecule includes a fusion, e.g., resulting in an in-frame fusion, of at least exon 1 of MEX3A or a fragment thereof (e.g., exon 1 of MEX3A or a fragment thereof), and at least exon 9 or a fragment thereof (e.g., one or more of exons 9-17) of NTRK1 or a fragment thereof. In yet other embodiments, the nucleic acid molecule includes a fragment of the nucleotide sequence shown in FIG. 2 (SEQ ID NO: 1) and a fragment of the nucleotide sequence shown in FIG. 4 (SEQ ID NO: 3), or a sequence substantially identical thereto (e.g., at least 70%, 75%, 80%, 8%, 90%, 91%, 92%, 93%, 94%, 95%, 96%, 97%, 98%, 99%, or 99.5% identical thereto), or the nucleotide sequence shown in FIG. 6 (SEQ ID NO: 5), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the nucleic acid molecule is complementary to at least a portion of a nucleotide sequence disclosed herein, e.g., is capable of hybridizing under a stringency condition described herein to SEQ ID NO: 1 and/or SEQ ID NO: 3, or SEQ ID NO: 5, or a fragment of any of the aforesaid nucleic acid sequences. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO: 1 and/or SEQ ID NO: 3, or SEQ ID NO: 5, or a fragment thereof. The nucleotide sequence of a cDNA encoding an exemplary 5'-MEX3A-NTRK1-3' fusion is shown in at least exon 1 (e.g., exon 1) of SEQ ID NO: 1 and at least exons 9-17 (e.g., exons 9-17) of SEQ ID NO: 3; or SEQ ID NO: 5, and the predicted amino acid sequence is shown in the corresponding encoded exons of SEQ ID NO: 2 and the corresponding encoded exons of SEQ ID NO: 4, respectively; or the amino acid sequence of SEQ ID NO: 6.

In an embodiment, the MEX3A-NTRK1 nucleic acid molecule comprises sufficient MEX3A nucleic acid sequence and sufficient NTRK1 nucleic acid sequence such that the encoded 5'-MEX3A-NTRK1-3' fusion polypeptide has a kinase activity, e.g., has an elevated activity, e.g., an NTRK1 kinase activity, as compared with wildtype NTRK1, e.g., in a cell of a cancer referred to herein. In certain embodiments, the 5'-MEX3A-NTRK1-3' fusion comprises exon 1 from MEX3A and exons 9-17 from NTRK1. In certain embodiments, the MEX3A-NTRK1 fusion comprises at least 1 or more encoded exons from MEX3A and at least 1, 2, 3, 4, 5, 6, 7, 8, or more, encoded exons from NTRK1. In certain embodiments, the MEX3A-NTRK1 fusion comprises a fusion of exon 1 from MEX3A and exons 9-17 from NTRK1.

In one embodiment, the nucleic acid molecule includes a nucleotide sequence that has an in-frame fusion of intron 1 of MEX3A (e.g., NM_001093725.2) with intron 8 of NTRK1 (e.g., NM_002529.3). In another embodiment, the nucleic acid molecule includes a nucleotide sequence that includes a breakpoint. For example, the nucleic acid molecule includes a nucleotide sequence that includes the fusion junction between the MEX3A gene and the NTRK1 gene, e.g., the fusion junction between intron 1 of MEX3A and intron 8 of NTRK1. In other embodiments, the nucleic acid molecule includes a nucleotide at nucleotide 156,051,070 (plus or minus 10, 20, 30, 40, 50, 60, 70, 80, 90, 100, or more nucleotides) to nucleotide 156,051,319 (plus or minus 10, 20, 30, 40, 50, 60, 70, 80, 90, 100, or more nucleotides) of chromosome 1 coupled to (e.g., directly or indirectly juxtaposed to) nucleotide 156,843,777 (plus or minus 10, 20, 30, 40, 50, 60, 70, 80, 90, 100, or more nucleotides) to nucleotide 156,843,890 (plus or minus 10, 20, 30, 40, 50, 60, 70, 80, 90, 100, or more nucleotides) of chromosome 1 (corresponding to the breakpoint of a MEX3A-NTRK1 fusion), or a fragment thereof, or a sequence substantially identical thereto, or an associated mutation.

In one embodiment, the nucleic acid molecule is complementary to at least a portion of a nucleotide sequence disclosed herein, e.g., is capable of hybridizing under a stringency condition described herein to one, two, or three of SEQ ID NOs: 1, 3, or 5 or a fragment thereof of any of the foregoing. In yet other embodiments, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to one, two, or three of SEQ ID NOs: 1, 3, or 5 or a fragment thereof of any of the foregoing.

In another embodiment, the MEX3A-NTRK1 fusion nucleic acid comprises at least 6, 12, 15, 20, 25, 50, 75, 100, or more nucleotides from exon 1 of MEX3A (e.g., from the nucleotide sequence of MEX3A preceding the fusion junction with NTRK1, e.g., of the MEX3A sequence shown in FIG. 2 (SEQ ID NO: 1)), and at least 6, 12, 15, 20, 25, 50, 75, 100, or more nucleotides from exons 9-17 of NTRK1 (e.g., from the nucleotide sequence of NTRK1 following the fusion junction with MEX3A, e.g., of the NTRK1 sequence shown in FIG. 4 (SEQ ID NO: 3)).

In other embodiments, the nucleic acid molecule includes a nucleotide sequence encoding a MEX3A-NTRK1 fusion polypeptide that includes a fragment of a MEX3A gene and a fragment of an NTRK1 gene. In one embodiment, the nucleotide sequence encodes a MEX3A-NTRK1 fusion polypeptide that includes e.g., an NTRK1 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 3 (e.g., SEQ ID NO: 2) and a nucleotide sequence encoding the amino acid sequence (e.g., a fragment of the amino acid sequence) shown in FIG. 5 (e.g., SEQ ID NO: 4), or a fragment of the fusion, or a sequence substantially identical thereto. In yet other embodiments, the nucleic acid includes a nucleotide sequence encoding the amino acid sequence of shown in FIG. 7 (e.g., SEQ ID NO: 6), or a fragment thereof (or a sequence substantially identical thereto). In one embodiment, the encoded MEX3A-NTRK1 fusion polypeptide includes an NTRK1 tyrosine kinase domain (e.g., one or more of exons 13-17 of SEQ ID NO: 3, or a functional fragment thereof).

In a related aspect, the disclosure features nucleic acid constructs that include the MEX3A-NTRK1 fusion nucleic acid molecules described herein. In certain embodiments, the nucleic acid molecules are operatively linked to a native or a heterologous regulatory sequence. Also included are vectors and host cells that include the MEX3A-NTRK1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the disclosure features nucleic acid molecules that reduce or inhibit the expression of a nucleic acid molecule that encodes a MEX3A-NTRK1 fusion molecule described herein. Examples of such nucleic acid molecules include, for example, antisense molecules, ribozymes, RNAi, or triple helix molecules that hybridize to a nucleic acid encoding a MEX3A-NTRK1 fusion polypeptide, or a transcription regulatory region of a MEX3A-NTRK1 fusion nucleic acid molecule, and block or reduce mRNA expression of a MEX3A-NTRK1 fusion nucleic acid molecule.

Detection of MEX3A-NTRK1 Fusion Nucleic Acid Molecules

The disclosure also features a nucleic acid molecule (e.g., nucleic acid fragment, suitable as a probe, primer, bait, or a library member, that includes, flanks, or hybridizes to) which is useful for identifying, or is otherwise based on, a MEX3A-NTRK1 fusion described herein. In certain embodiments, the probe, primer bait, or library member is an oligonucleotide that allows capture, detection, or isolation of a MEX3A-NTRK1 fusion nucleic acid molecule described herein. The oligonucleotide can comprise a nucleotide sequence substantially complementary to a fragment of the MEX3A-NTRK1 fusion nucleic acid molecules described herein. The sequence identity between the nucleic acid fragment, e.g., the oligonucleotide, and the target MEX3A-NTRK1 sequence need not be exact, so long as the sequences are sufficiently complementary to allow the capture, detection or isolation of the target sequence. In one embodiment, the nucleic acid fragment is a probe or primer that includes between about 5 and 25, e.g., between 10 and 20, or 10 and 15 nucleotides. In other embodiments, the nucleic acid fragment is a bait that includes about 100 to 300 nucleotides, 130 and 230 nucleotides, or 150 and 200 nucleotides.

In one embodiment, the nucleic acid fragment can be used to identify or capture, e.g., by hybridization, a MEX3A-NTRK1 fusion. For example, the nucleic acid fragment can be a probe, a primer, or a bait, for use in identifying or capturing, e.g., by hybridization, a MEX3A-NTRK1 fusion molecule described herein. In one embodiment, the nucleic acid fragment can be useful for identifying or capturing a breakpoint associated with a MEX3A-NTRK1 fusion nucleic acid molecule described herein, e.g., the nucleotide sequence of: chromosome 1 at nucleotide 156,051,070 (plus or minus 10, 20, 30, 40, 50, 60, 70, 80, 90, 100, or more nucleotides) to nucleotide 156,051,319 (plus or minus 10, 20, 30, 40, 50, 60, 70, 80, 90, 100, or more nucleotides) and chromosome 1 at nucleotide 156,843,777 (plus or minus 10, 20, 30, 40, 50, 60, 70, 80, 90, 100, or more nucleotides) to nucleotide 156,843,890 (plus or minus 10, 20, 30, 40, 50, 60, 70, 80, 90, 100, or more nucleotides), or an associated mutation.

In one embodiment, the nucleic acid fragment hybridizes to a nucleotide sequence within a chromosomal rearrangement that creates an in-frame fusion of intron 1 of MEX3A with intron 8 of NTRK1. In one embodiment, the nucleic acid fragment hybridizes to a nucleotide sequence in the region of chromosome 1 at nucleotide 156,051,070 to nucleotide 156,051,319 coupled to (e.g., juxtaposed to) the region of chromosome 1 at nucleotide 156,843,777 to nucleotide 156,843,890. In one embodiment, the nucleic acid fragment hybridizes to a nucleotide sequence that includes a breakpoint, e.g., the nucleotide sequence of: chromosome 1 at nucleotide 156,051,070 (plus or minus 10, 20, 30, 40, 50, 60, 70, 80, 90, 100, or more nucleotides) to nucleotide 156,051,319 (plus or minus 10, 20, 30, 40, 50, 60, 70, 80, 90, 100, or more nucleotides) and chromosome 1 at nucleotide 156,843,777 (plus or minus 10, 20, 30, 40, 50, 60, 70, 80, 90, 100, or more nucleotides) to nucleotide 156,843,890 (plus or minus 10, 20, 30, 40, 50, 60, 70, 80, 90, 100, or more nucleotides). For example, the nucleic acid fragment can hybridize to a nucleotide sequence that includes the fusion junction between the MEX3A gene and the NTRK1 gene, e.g., a nucleotide sequence that includes a portion of a nucleotide sequence within intron 1 of a MEX3A gene and intron 8 of an NTRK1 gene.

In another embodiment, the nucleic acid fragment hybridizes to a nucleotide sequence that comprises at least 6, 12, 15, 20, 25, 50, 75, 100, 150, or more nucleotides from exon 1 of MEX3A (e.g., from the nucleotide sequence of MEX3A preceding the fusion junction with NTRK1, e.g., of the MEX3A sequence shown in FIG. 2 (SEQ ID NO: 1)), and at least 6, 12, 15, 20, 25, 50, 75, 100, 150, or more nucleotides from exons 9-17 of NTRK1 (e.g., from the nucleotide sequence of NTRK1 following the fusion junction with MEX3A, e.g., of the NTRK1 sequence shown in FIG. 4 (SEQ ID NO: 3)).

The probes or primers described herein can be used, for example, for FISH detection or PCR amplification. In one exemplary embodiment where detection is based on PCR, amplification of the MEX3A-NTRK1 fusion junction can be performed using a primer or a primer pair, e.g., for amplifying a sequence flanking the fusion junctions described herein, e.g., the junction of a chromosomal rearrangement described herein, e.g., a MEX3A-NTRK1 fusion nucleic acid molecule described herein.

In one embodiment, a pair of isolated oligonucleotide primers can amplify a region containing or adjacent to a position in the MEX3A-NTRK1 fusion. For example, forward primers can be designed to hybridize to a nucleotide sequence within MEX3A genomic or mRNA sequence (e.g., a nucleotide sequence within exon 1 of MEX3A of SEQ ID NO: 1), and the reverse primers can be designed to hybridize to a nucleotide sequence of NTRK1 (e.g., a nucleotide sequence within exons 9-17 of NTRK1 of SEQ ID NO: 3).

In another embodiment, the nucleic acid fragments can be used to identify, e.g., by hybridization, a MEX3A-NTRK1 fusion molecule. In one embodiment, the nucleic acid fragment hybridizes to a nucleotide sequence that includes a fusion junction between the MEX3A gene and the NTRK1 gene.

In certain embodiments, the nucleic acid fragments are used in a FISH assay. In one embodiment, the FISH assay is a break-apart FISH assay. In one embodiment, at least two nucleic acid fragments (e.g., probes) hybridize to (e.g., are complementary to) at least two preselected nucleotide sequences of the MEX3A-NTRK1 fusion molecule, such that a change in (e.g., the presence or absence of) a signal associated with the nucleic acid fragments, e.g., a fluorescent signal, is indicative of the presence or absence of the MEX3A-NTRK1 fusion molecule or an intact MEX3A or NTRK1. Typically, the nucleic acid fragments are associated with a label or signal, e.g., a covalently or non-covalently associated signal or label chosen from, e.g., a radiolabel, a fluorescent label, a bioluminescent label, a chemiluminescent label, an enzyme label, a binding pair label, or an affinity tag.

In some exemplary embodiments, at least one first nucleic acid fragment (e.g., probe) hybridizes to a nucleotide sequence of MEX3A (e.g., a nucleotide sequence within exon 1 of MEX3A of SEQ ID NO: 1), and at least one second nucleic acid fragment (e.g., probe) hybridizes to a nucleotide sequence of NTRK1 (e.g., a nucleotide sequence within exons 9-17 of NTRK1 of SEQ ID NO: 3). The first and second fragments can be associated with a detectable label or signal, e.g., a fluorescent signal, such that a different signal is detected when the first and second nucleic acid fragments are in close proximity when a MEX3A-NTRK1 fusion nucleotide sequence is present, compared to a MEX3A or NTRK1 nucleotide sequence (e.g., an intact, full length MEX3A or NTRK1 nucleotide sequence).

In other embodiments, the nucleic acid fragment includes a bait that comprises a nucleotide sequence that hybridizes to a MEX3A-NTRK1 fusion nucleic acid molecule described herein, and thereby allows the capture or isolation of said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a MEX3A-NTRK1 nucleic acid molecule described herein. In one embodiment, the library member includes a rearrangement that results in a MEX3A-NTRK1 fusion molecule described herein.

The nucleic acid fragment can be detectably labeled with, e.g., a radiolabel, a fluorescent label, a bioluminescent label, a chemiluminescent label, an enzyme label, a binding pair label, or can include an affinity tag, a tag, or identifier (e.g., an adaptor, barcode, or other sequence identifier).

MEX3A-NTRK1 Fusion Polypeptides

In another embodiment, the MEX3A-NTRK1 fusion polypeptide comprises an amino acid sequence (e.g., a fragment of the amino acid sequence) shown in FIG. 3 (SEQ ID NO: 2) and an amino acid sequence (e.g., a fragment of the amino acid sequence) shown in FIG. 5 (SEQ ID NO: 4), or a fragment of the fusion. In one embodiment, the MEX3A-NTRK1 fusion polypeptide comprises an amino acid sequence substantially identical to the amino acid sequence (e.g., a fragment of the amino acid sequence) shown in FIG. 3 (SEQ ID NO: 2) and the amino acid sequence (e.g., a fragment of the amino acid sequence) shown in FIG. 5 (SEQ ID NO: 4), or a fragment thereof. In one embodiment, the MEX3A-NTRK1 fusion polypeptide comprises an amino acid sequence at least 70%, 75%, 80%, 85%, 90%, 91%, 92%, 93%, 94%, 95%, 96%, 97%, 98%, 99%, or 99.5% identical to the amino acid sequence (e.g., a fragment of the amino acid sequence) shown in FIG. 3 (SEQ ID NO: 2) and the amino acid sequence (e.g., a fragment of the amino acid sequence) shown in FIG. 5 (SEQ ID NO: 4).

In one embodiment, the MEX3A-NTRK1 fusion polypeptide comprises a sequence containing at least 10, 20, 50, 100, 500, 600, 700, 800, 900, 1000, or more amino acids of the amino acid sequences shown in FIG. 3 (SEQ ID NO: 2) and FIG. 5 (SEQ ID NO: 4) in combination. In one embodiment, the MEX3A-NTRK1 fusion polypeptide comprises an amino acid sequence containing at least 5, 10, 20, 50, 100, 500, or more amino acids (e.g., contiguous amino acids) of the amino acid sequence shown in FIG. 3 (SEQ ID NO: 2) and at least 5, 10, 20, 50, 100, 500, 600, 700, or more amino acids (e.g., contiguous amino acids) of the amino acid sequence shown in FIG. 5 (SEQ ID NO: 4).

In one embodiment, the 5'-MEX3A-NTRK1-3' fusion polypeptide includes an NTRK1 receptor tyrosine kinase domain or a functional fragment thereof. In an embodiment, the 5'-MEX3A-NTRK1-3' fusion polypeptide comprises sufficient NTRK1 sequence and sufficient MEX3A sequence such that it has a kinase activity, e.g., has an elevated activity, e.g., an NTRK1 kinase activity, as compared with wildtype NTRK1, e.g., in a cell of a cancer described herein (e.g., an ovarian cancer, e.g., an ovarian carcinosarcoma).

In yet other embodiments, the MEX3A-NTRK1 fusion polypeptide comprises the amino acid sequence of SEQ ID NO: 6 (FIG. 7), or an amino acid sequence substantially identical thereto (e.g., at least 70%, 75%, 80%, 85%, 90%, 91%, 92%, 93%, 94%, 95%, 96%, 97%, 98%, 99%, or 99.5% identical to the amino acid sequence, or a fragment of the amino acid sequence).

In another aspect, the disclosure features a MEX3A-NTRK1 fusion polypeptide (e.g., a purified MEX3A-NTRK1 fusion polypeptide), a biologically active or antigenic fragment thereof, as well as reagents (e.g., antibody molecules that bind to a MEX3A-NTRK1 fusion polypeptide), methods for modulating a MEX3A-NTRK1 polypeptide activity, and detection of a MEX3A-NTRK1 polypeptide.

In one embodiment, the MEX3A-NTRK1 fusion polypeptide has at least one biological activity, e.g., an NTRK1 kinase activity. In one embodiment, at least one biological activity of the MEX3A-NTRK1 fusion polypeptide is reduced or inhibited by an anti-cancer drug, e.g., a kinase inhibitor (e.g., a multikinase inhibitor or an NTRK1-specific inhibitor). Exemplary multikinase inhibitors include, e.g., KRC-108, crizotinib, and K252a. In one embodiment, at least one biological activity of the MEX3A-NTRK1 fusion polypeptide is reduced or inhibited by an NTRK kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo [2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928. In certain embodiments, the NTRK kinase inhibitor is larotrectinib.

In yet other embodiments, the MEX3A-NTRK1 fusion polypeptide is encoded by a nucleic acid molecule described herein. In one embodiment, the MEX3A-NTRK1 fusion polypeptide is encoded by an in-frame fusion of intron 1 of MEX3A with intron 8 of NTRK1 (e.g., a sequence on chromosome 1). In another embodiment, the MEX3A-NTRK1 fusion polypeptide includes an amino acid sequence encoded by a nucleotide sequence comprising a fusion junction between the MEX3A transcript and the NTRK1 transcript.

In certain embodiments, the MEX3A-NTRK1 fusion polypeptide comprises encoded exon 1 from MEX3A and one or more of encoded exons 9-17 of NTRK1. In certain embodiments, the MEX3A-NTRK1 fusion polypeptide comprises at least 1 or more encoded exons from MEX3A and at least 1, 2, 3, 4, 5, 6, 7, 8, or more, encoded exons from NTRK1. In certain embodiments, the MEX3A-NTRK1 fusion polypeptide comprises a fusion of encoded exon 1 from MEX3A and encoded exons 9-17 from NTRK1 (or a fragment thereof). In certain embodiments, the MEX3A-NTRK1 fusion polypeptide comprises encoded exon 1 from MEX3A and encoded exons 9-17 of NTRK1 (e.g., a fusion junction of the sequence of encoded exon 1 from MEX3A and the sequence of encoded exon 9 from NTRK1).

In certain embodiments, the MEX3A-NTRK1 fusion comprises the amino acid sequence corresponding to exon 1 or a fragment thereof from MEX3A (e.g., as shown in FIG. 3 (SEQ ID NO: 2)), and the amino acid sequence corresponding to exons 9-17 or a fragment thereof from NTRK1 (e.g., as shown in FIG. 5 (SEQ ID NO: 4)). In one embodiment, the MEX3A-NTRK1 fusion comprises at least 5, 10, 15, 20, or more amino acids from exon 1 of MEX3A (e.g., from the amino acid sequence of MEX3A preceding the fusion junction with NTRK1, e.g., of the MEX3A sequence shown in FIG. 3 (SEQ ID NO:2)), and at least 5, 10, 15, 20, or more amino acids from exon 9 of NTRK1 (e.g., from the amino acid sequence of NTRK1 following the fusion junction with MEX3A, e.g., of the NTRK1 sequence shown in FIG. 5 (SEQ ID NO: 4)).

In one embodiment, the MEX3A-NTRK1 fusion polypeptide includes an NTRK1 tyrosine kinase domain or a functional fragment thereof. In a related aspect, the disclosure features MEX3A-NTRK1 fusion polypeptides or fragments operatively linked to heterologous polypeptides to form fusion proteins.

In another embodiment, the MEX3A-NTRK1 fusion polypeptide or fragment is a peptide, e.g., an immunogenic peptide or protein that contains a fusion junction described herein. Such immunogenic peptides or proteins can be used to raise antibodies specific to a fusion protein. In other embodiments, such immunogenic peptides or proteins can be used for vaccine preparation. The vaccine preparation can include other components, e.g., an adjuvant.

In another aspect, the disclosure features antibody molecules that bind to a MEX3A-NTRK1 fusion polypeptide or fragment described herein. In some embodiments, the antibody can distinguish wildtype NTRK1 (or MEX3A) from a MEX3A-NTRK1 fusion polypeptide described herein.

CARM1-NTRK3 Fusions

Disclosed herein are fusion molecules that comprise all or part of CARM1 and all or part of NTRK3. A CARM1-NTRK3 fusion molecule described herein includes any fusion molecule (e.g., gene, gene product (e.g., cDNA, mRNA, or polypeptide), and variant thereof) that includes a fragment of a CARM1 gene or gene product and a fragment of an NTRK3 gene or gene product described herein, including, e.g., a CARM1-NTRK3 fusion molecule as summarized in FIGS. 1A-1C. Expression of the fusion molecules was detected in cancer tissues, thus suggesting an association with cancer, e.g., a melanoma, e.g., a vaginal melanoma.

In one embodiment, the CARM1-NTRK3 fusion molecule includes an in-frame fusion of an exon of CARM1, e.g., one or more exons of CARM1 (e.g., exons 1-3 of CARM1 of FIG. 8 (SEQ ID NO: 7)) or a fragment thereof, and an exon of NTRK3, e.g., one or more exons of an NTRK3 (e.g., one or more of exons 3-19 of NTRK3 of FIG. 10 (SEQ ID NO: 9)) or a fragment thereof. In another embodiment, the fusion molecule includes the nucleotide sequence of SEQ ID NO: 11 (FIG. 12) or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion molecule encodes the amino acid sequence of SEQ ID NO: 12 (FIG. 13), or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

For example, the CARM1-NTRK3 fusion molecule can include an in-frame fusion within an intron of CARM1 (e.g., intron 3) or a fragment thereof, with an intron of NTRK3 (e.g., intron 2) or a fragment thereof. In one embodiment, the CARM1-NTRK3 fusion comprises the nucleotide sequence of: chromosome 15 at nucleotide 88,799,136 (plus or minus 10, 20, 30, 40, 50, 60, 70, 80, 90, 100, or more nucleotides) to nucleotide 88,799,434 (plus or minus 10, 20, 30, 40, 50, 60, 70, 80, 90, 100, or more nucleotides) and chromosome 19 at nucleotide 11,019,501 (plus or minus 10, 20, 30, 40, 50, 60, 70, 80, 90, 100, or more nucleotides) to nucleotide 11,019,751 (plus or minus 10, 20, 30, 40, 50, 60, 70, 80, 90, 100, or more nucleotides). In one embodiment, the nucleotide sequence flanking the breakpoint of CARM1 comprises the nucleotide sequence of SEQ ID NO: 15 (FIG. 16) or a fragment thereof. In one embodiment, the nucleotide sequence flanking the breakpoint of NTRK3 comprises the nucleotide sequence of SEQ ID NO: 16 (FIG. 17) or a fragment thereof. In one embodiment, the CARM1-NTRK3 fusion is a translocation, e.g., a translocation of chromosome 15 and chromosome 19. In certain embodiments, the CARM1-NTRK3 fusion polypeptide is in a 5'-CARM1 to 3'-NTRK3 configuration (also referred to herein as "5'-CARM1-NTRK3-3'"). The term "fusion" or "fusion molecule" can refer to a fusion polypeptide or a fusion nucleic acid/fusion nucleic acid molecule, depending on the context. It may include a full-length sequence of a fusion or a fragment thereof, e.g., a fragment comprising a fusion junction (e.g., a fragment including a portion of CARM1 and a portion of NTRK3, e.g., a portion of the CARM1-NTRK3 fusion molecule described herein). In one embodiment, the CARM1-NTRK3 fusion polypeptide includes a fragment of the amino acid sequence shown in FIG. 9 (SEQ ID NO: 8) and a fragment of the amino acid sequence shown in FIG. 11 (SEQ ID NO: 10), or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the CARM1-NTRK3 fusion polypeptide includes the amino acid sequence of SEQ ID NO: 12 shown in FIG. 13, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In another embodiment, the CARM1-NTRK3 fusion nucleic acid molecule includes a fragment of the nucleotide sequence shown in FIG. 8 (SEQ ID NO: 7) and a fragment of the nucleotide sequence shown in FIG. 10 (SEQ ID NO: 9), or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes the nucleotide sequence of SEQ ID NO: 11 (FIG. 12) or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion nucleic acid molecule includes a nucleotide sequence encoding the amino acid sequence of SEQ ID NO: 12 (FIG. 13), or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the CARM1-NTRK3 fusion polypeptide comprises sufficient CARM1 sequence and sufficient NTRK3 sequence such that the 5'-CARM1-NTRK3-3' fusion has a kinase activity, e.g., has an elevated (e.g., constitutive) activity, e.g., an NTRK3 tyrosine kinase activity, as compared with wildtype NTRK3, e.g., in a cell of a cancer described to herein (e.g., a melanoma, e.g., a vaginal melanoma).

In certain embodiments, the CARM1-NTRK3 fusion comprises exons 1-3 (or the corresponding amino acid sequence encoded by exons 1-3) from CARM1 of SEQ ID NO: 7 or 8 (FIG. 8 or 9, respectively), and one or more of (e.g., all of) exons 3-19 (or the corresponding amino acid sequence encoded by exons 3-19) of NTRK3 of SEQ ID NO: 9 or 10 (FIG. 10 or 11, respectively). In certain embodiments, the CARM1-NTRK3 fusion comprises at least 1, 2, or more exons (or encoded exons) from CARM1 and at least 1, 2, 3, 4, 5, 6, 7, 8, 9, 10, 11, 12, 13, 14, 15, 16, or more exons (or encoded exons) from NTRK3 (e.g., from the CARM1 and NTRK3 nucleotide sequences shown in FIG. 8 and FIG. 10 (SEQ ID NOs: 7 and 9) or the amino acid sequences shown in FIG. 9 and FIG. 11 (SEQ ID NOs: 8 and 10)). In certain embodiments, the CARM1-NTRK3 fusion comprises encoded exons 1-3 of CARM1 and encoded exons 3-19 of NTRK3.

In one embodiment, the CARM1-NTRK3 fusion comprises at least 5, 10, 15, 20, 25, 30, 40, 50, or more amino acids from one, two, or more of exons 1-3 of CARM1 (e.g., from the amino acid sequence of CARM1 as shown in FIG. 9 (SEQ ID NO: 8)) (e.g., from the amino acid sequence of CARM1 preceding the fusion junction with NTRK3), and at least 5, 10, 15, 20, 25, 30, 40, 50, or more amino acids from one, two, three, four, five, six, seven, eight, nine, 10, 11, 12, 13, 14, 15, 16, or more of exons 3-19 of NTRK3 (e.g., from the amino acid sequence of NTRK3 as shown in FIG. 11 (SEQ ID NO: 10)) (e.g., from the amino acid sequence of NTRK3 following the fusion junction with CARM1). In another embodiment, the CARM1-NTRK3 fusion comprises at least 6, 12, 15, 20, 25, 50, 75, 100, or more nucleotides from one, two, or more of exons 1-3 of CARM1 (e.g., from the nucleotide sequence of CARM1 as shown in FIG. 8 (SEQ ID NO: 7) (e.g., from the nucleotide sequence of CARM1 preceding the fusion junction with NTRK3); and at least 6, 12, 15, 20, 25, 50, 75, 100, or more nucleotides from one, two, three, four, five, six, seven, eight, nine, 10, 11, 12, 13, 14, 15, 16, or more of exons 3-19 of NTRK3 (e.g., from the nucleotide sequence of NTRK3 as shown in FIG. 10 (SEQ ID NO: 9)).

CARM1-NTRK3 Fusion Nucleic Acid Molecules

In one aspect, the disclosure features a nucleic acid molecule (e.g., an isolated or purified nucleic acid molecule) that includes a fragment of a CARM1 gene and a fragment of an NTRK3 gene. In one embodiment, the fusion nucleic acid molecule includes a nucleotide sequence encoding a CARM1-NTRK3 fusion polypeptide that includes an NTRK3 tyrosine kinase domain or a functional fragment thereof. In other embodiments, the fusion nucleic acid molecule includes a nucleotide sequence encoding a fragment of the CARM1 polypeptide including the amino acid sequence of SEQ ID NO: 8 or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes a nucleotide sequence encoding a fragment of the NTRK3 polypeptide including the amino acid sequence of SEQ ID NO: 10 or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding the amino acid sequence shown in FIG. 9 (SEQ ID NO: 8), or a fragment thereof, and the amino acid sequence shown in FIG. 11 (SEQ ID NO: 10) or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding the amino acid sequence shown in FIG. 13 (SEQ ID NO: 12), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the CARM1-NTRK3 nucleic acid molecule includes a fusion, e.g., resulting in an in-frame fusion, between an intron of CARM1 (e.g., intron 3, or a fragment thereof) and an intron of NTRK3 (e.g., intron 2, or a fragment thereof). The CARM1-NTRK3 fusion nucleic acid molecule can comprise a fusion of the nucleotide sequence of: chromosome 15 at nucleotide 88,799,136 (plus or minus 10, 20, 30, 40, 50, 60, 70, 80, 90, 100, or more nucleotides) to nucleotide 88,799,434 (plus or minus 10, 20, 30, 40, 50, 60, 70, 80, 90, 100, or more nucleotides) and chromosome 19 at nucleotide 11,019,501 (plus or minus 10, 20, 30, 40, 50, 60, 70, 80, 90, 100, or more nucleotides) to nucleotide 11,019,751 (plus or minus 10, 20, 30, 40, 50, 60, 70, 80, 90, 100, or more nucleotides).

In another embodiment, the CARM1-NTRK3 fusion nucleic acid molecule comprises a nucleotide sequence (e.g., a fragment of a nucleotide sequence) shown in FIG. 8 (SEQ ID NO: 7) and a nucleotide sequence (e.g., a fragment of a nucleotide sequence) shown in FIG. 10 (SEQ ID NO: 9), or a fragment of the fusion nucleic acid molecule. In one embodiment, the CARM1-NTRK3 fusion nucleic acid molecule comprises a nucleotide sequence substantially identical to the nucleotide sequence (e.g., a fragment of a nucleotide sequence) shown in FIG. 8 (SEQ ID NO: 7) and the nucleotide sequence (e.g., a fragment of a nucleotide sequence) shown FIG. 10 (SEQ ID NO: 9), or a fragment of the fusion. In another embodiment, the CARM1-NTRK3 fusion nucleic acid molecule comprises a nucleotide sequence (e.g., a fragment of a nucleotide sequence) shown in FIG. 12 (SEQ ID NO: 11), or a fragment of the fusion. In one embodiment, the CARM1-NTRK3 fusion nucleic acid molecule comprises a nucleotide sequence substantially identical to the nucleotide sequence (e.g., a fragment of a nucleotide sequence) shown in FIG. 12 (SEQ ID NO: 11), or a fragment of the fusion.

In one embodiment, the CARM1-NTRK3 fusion nucleic acid molecule comprises a nucleotide sequence at least 70%, 75%, 80%, 85%, 90%, 91%, 92%, 93%, 94%, 95%, 96%, 97%, 98%, 99%, or 99.5% identical to the nucleotide sequence (e.g., a fragment of a nucleotide sequence) shown in FIG. 8 (SEQ ID NO: 7) and to the nucleotide sequence (e.g., a fragment of a nucleotide sequence) shown in FIG. 10 (SEQ ID NO: 9). In yet other embodiments, the CARM1-NTRK3 fusion nucleic acid molecule comprises the nucleotide sequence of SEQ ID NO: 11 (FIG. 12), or a fragment thereof, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical to the nucleotide sequence, or a fragment of a nucleotide sequence). In one embodiment, the CARM1-NTRK3 fusion nucleic acid molecule comprises a nucleotide sequence containing at least 25, 50, 100, 150, 200, 500, 1000, 1500, 2000, 2500, 3000, or more nucleotides of the nucleotide sequence shown in FIG. 8 (SEQ ID NO: 7) and a nucleotide sequence containing at least 25, 50, 100, 150, 200, 500, 1000, 1500, 2000, 2500, or more nucleotides of the nucleotide sequence shown in FIG. 10 (SEQ ID NO: 9). In one embodiment, the CARM1-NTRK3 fusion nucleic acid molecule comprises a nucleotide sequence containing at least 25, 50, 100, 150, 200, 500, 1000, 1500, 2000, 2500, 3000, or more nucleotides (e.g., contiguous nucleotides) of the nucleotide sequence shown in FIG. 8 (SEQ ID NO: 7) and a nucleotide sequence containing at least 25, 50, 100, 150, 200, 500, 1000, 1500, 2000, 2500, or more nucleotides of the nucleotide sequence shown in FIG. 10 (SEQ ID NO: 9).

In another embodiment, the nucleic acid molecule includes a fusion, e.g., resulting in an in-frame fusion, of at least exon 3 of CARM1 or a fragment thereof (e.g., exons 1-3 of CARM1 or a fragment thereof), and at least exon 3 or a fragment thereof (e.g., one or more of exons 3-19) of NTRK3 or a fragment thereof. In yet other embodiments, the nucleic acid molecule includes a fragment of the nucleotide sequence shown in FIG. 8 (SEQ ID NO: 7) and a fragment of the nucleotide sequence shown in FIG. 10 (SEQ ID NO: 9), or a sequence substantially identical thereto (e.g., at least 70%, 75%, 80%, 85%, 90%, 91%, 92%, 93%, 94%, 95%, 96%, 97%, 98%, 99%, or 99.5% identical thereto), or the nucleotide sequence shown in FIG. 12 (SEQ ID NO: 11), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the nucleic acid molecule is complementary to at least a portion of a nucleotide sequence disclosed herein, e.g., is capable of hybridizing under a stringency condition described herein to SEQ ID NO: 7 and/or SEQ ID NO: 9, or SEQ ID NO: 11, or a fragment of any of the aforesaid nucleic acid sequences. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence complementary to SEQ ID NO: 7 and/or SEQ ID NO: 9, or SEQ ID NO: 11, or a fragment thereof. The nucleotide sequence of a cDNA encoding an exemplary 5'-CARM1-NTRK3-3' fusion is shown in at least exons 1-3 (e.g., exons 1-3) of SEQ ID NO: 7 and at least exons 3-19 (e.g., exons 3-19) of SEQ ID NO: 9; or SEQ ID NO: 11, and the predicted amino acid sequence is shown in the corresponding encoded exons of SEQ ID NO: 8 and the corresponding encoded exons of SEQ ID NO: 10, respectively; or the amino acid sequence of SEQ ID NO: 12.

In an embodiment, the CARM1-NTRK3 nucleic acid molecule comprises sufficient CARM1 nucleic acid sequence and sufficient NTRK3 nucleic acid sequence such that the encoded 5'-CARM1-NTRK3-3' fusion polypeptide has a kinase activity, e.g., has an elevated activity, e.g., an NTRK3 kinase activity, as compared with wildtype NTRK3, e.g., in a cell of a cancer referred to herein. In certain embodiments, the 5'-CARM1-NTRK3-3' fusion comprises exons 1-3 from CARM1 and exons 3-19 from NTRK3. In certain embodiments, the CARM1-NTRK3 fusion comprises at least one, two, or more encoded exons from CARM1 and at least one, two, three, four, five, six, seven, eight, nine, 10, 11, 12, 13, 14, 15, 16, or more encoded exons from NTRK3. In certain embodiments, the CARM1-NTRK3 fusion comprises a fusion of exons 1-3 from CARM1 and exons 3-19 from NTRK3.

In one embodiment, the nucleic acid molecule includes a nucleotide sequence that has an in-frame fusion of intron 3 of CARM1 (e.g., NM_199141.2) with intron 2 of NTRK3 (e.g., NM_002530.03). In another embodiment, the nucleic acid molecule includes a nucleotide sequence that includes a breakpoint. For example, the nucleic acid molecule includes a nucleotide sequence that includes the fusion junction between the CARM1 gene and the NTRK3 gene, e.g., the fusion junction between intron 3 of CARM1 and intron 2 of NTRK3. In other embodiments, the nucleic acid molecule includes a nucleotide at nucleotide 88,799,136 (plus or minus 10, 20, 30, 40, 50, 60, 70, 80, 90, 100, or more nucleotides) to nucleotide 88,799,434 (plus or minus 10, 20, 30, 40, 50, 60, 70, 80, 90, 100, or more nucleotides) of chromosome 15 coupled to (e.g., directly or indirectly juxtaposed to) nucleotide 11,019,501 (plus or minus 10, 20, 30, 40, 50, 60, 70, 80, 90, 100, or more nucleotides) to nucleotide 11,019,751 (plus or minus 10, 20, 30, 40, 50, 60, 70, 80, 90, 100, or more nucleotides) of chromosome 19 (corresponding to the breakpoint of a CARM1-NTRK3fusion), or a fragment thereof, or a sequence substantially identical thereto, or an associated mutation.

In one embodiment, the nucleic acid molecule is complementary to at least a portion of a nucleotide sequence disclosed herein, e.g., is capable of hybridizing under a stringency condition described herein to one, two, or three of SEQ ID NOs: 7, 9, or 11 or a fragment thereof of any of the foregoing. In yet other embodiments, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to one, two, or three of SEQ ID NOs: 7, 9, or 11 or a fragment thereof of any of the foregoing.

In another embodiment, the CARM1-NTRK3 fusion nucleic acid comprises at least 6, 12, 15, 20, 25, 50, 75, 100, or more nucleotides from exons 1-3 of CARM1 (e.g., from the nucleotide sequence of CARM1 preceding the fusion junction with NTRK3, e.g., of the CARM1 sequence shown in FIG. 8 (SEQ ID NO: 7)), and at least 6, 12, 15, 20, 25, 50, 75, 100, or more nucleotides from exons 3-19 of NTRK3 (e.g., from the nucleotide sequence of NTRK3 following the fusion junction with CARM1, e.g., of the NTRK3 sequence shown in FIG. 10 (SEQ ID NO: 9)).

In other embodiments, the nucleic acid molecule includes a nucleotide sequence encoding a CARM1-NTRK3 fusion polypeptide that includes a fragment of a CARM1 gene and a fragment of an NTRK3 gene. In one embodiment, the nucleotide sequence encodes a CARM1-NTRK3 fusion polypeptide that includes e.g., an NTRK3 tyrosine kinase domain or a functional fragment thereof. In yet other embodiments, the nucleic acid molecule includes a nucleotide sequence encoding the amino acid sequence (e.g., a fragment of the amino acid sequence) shown in FIG. 9 (e.g., SEQ ID NO: 8) and a nucleotide sequence encoding the amino acid sequence (e.g., a fragment of the amino acid sequence) shown in FIG. 11 (e.g., SEQ ID NO: 10), or a fragment of the fusion, or a sequence substantially identical thereto. In yet other embodiments, the nucleic acid includes a nucleotide sequence encoding the amino acid sequence of shown in FIG. 13 (e.g., SEQ ID NO: 12), or a fragment thereof (or a sequence substantially identical thereto). In one embodiment, the encoded CARM1-NTRK3 fusion polypeptide includes an NTRK3 tyrosine kinase domain (e.g., one or more of exons 14-19 of SEQ ID NO: 9, or a functional fragment thereof).

In a related aspect, the disclosure features nucleic acid constructs that include the CARM1-NTRK3 fusion nucleic acid molecules described herein. In certain embodiments, the nucleic acid molecules are operatively linked to a native or a heterologous regulatory sequence. Also included are vectors and host cells that include the CARM1-NTRK3 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the disclosure features nucleic acid molecules that reduce or inhibit the expression of a nucleic acid molecule that encodes a CARM1-NTRK3 fusion molecule described herein. Examples of such nucleic acid molecules include, for example, antisense molecules, ribozymes, RNAi, or triple helix molecules that hybridize to a nucleic acid encoding a CARM1-NTRK3 fusion polypeptide, or a transcription regulatory region of a CARM1-NTRK3 fusion nucleic acid molecule, and block or reduce mRNA expression of a CARM1-NTRK3 fusion nucleic acid molecule.

Detection of CARM1-NTRK3 Fusion Nucleic Acid Molecules

The disclosure also features a nucleic acid molecule (e.g., nucleic acid fragment, suitable as a probe, primer, bait, or a library member, that includes, flanks, or hybridizes to) which is useful for identifying, or is otherwise based on, a CARM1-NTRK3 fusion described herein. In certain embodiments, the probe, primer, bait, or library member is an oligonucleotide that allows capture, detection, or isolation of a CARM1-NTRK3 fusion nucleic acid molecule described herein. The oligonucleotide can comprise a nucleotide sequence substantially complementary to a fragment of the CARM1-NTRK3 fusion nucleic acid molecules described herein. The sequence identity between the nucleic acid fragment, e.g., the oligonucleotide, and the target CARM1-NTRK3 sequence need not be exact, so long as the sequences are sufficiently complementary to allow the capture, detection or isolation of the target sequence. In one embodiment, the nucleic acid fragment is a probe or primer that includes between about 5 and 25, e.g., between 10 and 20, or 10 and 15 nucleotides. In other embodiments, the nucleic acid fragment is a bait that includes about 100 to 300 nucleotides, 130 and 230 nucleotides, or 150 and 200 nucleotides.

In one embodiment, the nucleic acid fragment can be used to identify or capture, e.g., by hybridization, a CARM1-NTRK3 fusion. For example, the nucleic acid fragment can be a probe, a primer, or a bait, for use in identifying or capturing, e.g., by hybridization, a CARM1-NTRK3 fusion molecule described herein. In one embodiment, the nucleic acid fragment can be useful for identifying or capturing a breakpoint associated with a CARM1-NTRK3 fusion nucleic acid molecule described herein, e.g., the nucleotide sequence of: chromosome 15 at nucleotide 88,799,136 (plus or minus 10, 20, 30, 40, 50, 60, 70, 80, 90, 100, or more nucleotides) to nucleotide 88,799,434 (plus or minus 10, 20, 30, 40, 50, 60, 70, 80, 90, 100, or more nucleotides) and chromosome 19 at nucleotide 11,019,501 (plus or minus 10, 20, 30, 40, 50, 60, 70, 80, 90, 100, or more nucleotides) to nucleotide 11,019,751 (plus or minus 10, 20, 30, 40, 50, 60, 70, 80, 90, 100, or more nucleotides), or an associated mutation.

In one embodiment, the nucleic acid fragment hybridizes to a nucleotide sequence within a chromosomal rearrangement that creates an in-frame fusion of intron 3 of CARM1 with intron 2 of NTRK3. In one embodiment, the nucleic acid fragment hybridizes to a nucleotide sequence in the region of chromosome 15 at nucleotide 88,799,136 to nucleotide 88,799,434 coupled to (e.g., juxtaposed to) the region of chromosome 19 at nucleotide 11,019,501 to nucleotide 11,019,751. In one embodiment, the nucleic acid fragment hybridizes to a nucleotide sequence that includes a breakpoint, e.g., the nucleotide sequence of: chromosome 15 at nucleotide 88,799,136 (plus or minus 10, 20, 30, 40, 50, 60, 70, 80, 90, 100, or more nucleotides) to nucleotide 88,799,434 (plus or minus 10, 20, 30, 40, 50, 60, 70, 80, 90, 100, or more nucleotides) and chromosome 19 at nucleotide 11,019,501 (plus or minus 10, 20, 30, 40, 50, 60, 70, 80, 90, 100, or more nucleotides) to nucleotide 11,019,751 (plus or minus 10, 20, 30, 40, 50, 60, 70, 80, 90, 100, or more nucleotides). For example, the nucleic acid fragment can hybridize to a nucleotide sequence that includes the fusion junction between the CARM1 gene and the NTRK3 gene, e.g., a nucleotide sequence that includes a portion of a nucleotide sequence within intron 3 of a CARM1 gene and intron 2 of an NTRK3 gene.

In another embodiment, the nucleic acid fragment hybridizes to a nucleotide sequence that comprises at least 6, 12, 15, 20, 25, 50, 75, 100, 150, or more nucleotides from exons 1-3 of CARM1 (e.g., from the nucleotide sequence of CARM1 preceding the fusion junction with NTRK3, e.g., of the CARM1 sequence shown in FIG. 8 (SEQ ID NO: 7)), and at least 6, 12, 15, 20, 25, 50, 75, 100, 150, or more nucleotides from exons 3-19 of NTRK3 (e.g., from the nucleotide sequence of NTRK3 following the fusion junction with CARM1, e.g., of the NTRK3 sequence shown in FIG. 10 (SEQ ID NO: 9)).

The probes or primers described herein can be used, for example, for FISH detection or PCR amplification. In one exemplary embodiment where detection is based on PCR, amplification of the CARM1-NTRK3 fusion junction can be performed using a primer or a primer pair, e.g., for amplifying a sequence flanking the fusion junctions described herein, e.g., the junction of a chromosomal rearrangement described herein, e.g., a CARM1-NTRK3 fusion nucleic acid molecule described herein.

In one embodiment, a pair of isolated oligonucleotide primers can amplify a region containing or adjacent to a position in the CARM1-NTRK3 fusion. For example, forward primers can be designed to hybridize to a nucleotide sequence within CARM1 genomic or mRNA sequence (e.g., a nucleotide sequence within exons 1-3 of CARM1 of SEQ ID NO: 7), and the reverse primers can be designed to hybridize to a nucleotide sequence of NTRK3 (e.g., a nucleotide sequence within exons 3-19 of NTRK3 of SEQ ID NO: 9).

In another embodiment, the nucleic acid fragments can be used to identify, e.g., by hybridization, a CARM1-NTRK3 fusion molecule. In one embodiment, the nucleic acid fragment hybridizes to a nucleotide sequence that includes a fusion junction between the CARM1 gene and the NTRK3 gene.

In certain embodiments, the nucleic acid fragments are used in a FISH assay. In one embodiment, the FISH assay is a break-apart FISH assay. In one embodiment, at least two nucleic acid fragments (e.g., probes) hybridize to (e.g., are complementary to) at least two preselected nucleotide sequences of the CARM1-NTRK3 fusion molecule, such that a change in (e.g., the presence or absence of) a signal associated with the nucleic acid fragments, e.g., a fluorescent signal, is indicative of the presence or absence of the CARM1-NTRK3 fusion molecule or an intact CARM1 or NTRK3. Typically, the nucleic acid fragments are associated with a label or signal, e.g., a covalently or non-covalently associated signal or label chosen from, e.g., a radiolabel, a fluorescent label, a bioluminescent label, a chemiluminescent label, an enzyme label, a binding pair label, or an affinity tag.

In some exemplary embodiments, at least one first nucleic acid fragment (e.g., probe) hybridizes to a nucleotide sequence of CARM1 (e.g., a nucleotide sequence within exons 1-3 of CARM1 of SEQ ID NO: 7), and at least one second nucleic acid fragment (e.g., probe) hybridizes to a nucleotide sequence of NTRK3 (e.g., a nucleotide sequence within exons 3-19 of NTRK3 of SEQ ID NO: 9). The first and second fragments can be associated with a detectable label or signal, e.g., a fluorescent signal, such that a different signal is detected when the first and second nucleic acid fragments are in close proximity when a CARM1-NTRK3 fusion nucleotide sequence is present, compared to a CARM1 or NTRK3 nucleotide sequence (e.g., an intact, full length CARM1 or NTRK3 nucleotide sequence).

In other embodiments, the nucleic acid fragment includes a bait that comprises a nucleotide sequence that hybridizes to a CARM1-NTRK3 fusion nucleic acid molecule described herein, and thereby allows the capture or isolation of said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising a CARM1-NTRK3 nucleic acid molecule described herein. In one embodiment, the library member includes a rearrangement that results in a CARM1-NTRK3 fusion molecule described herein.

The nucleic acid fragment can be detectably labeled with, e.g., a radiolabel, a fluorescent label, a bioluminescent label, a chemiluminescent label, an enzyme label, a binding pair label, or can include an affinity tag, a tag, or identifier (e.g., an adaptor, barcode, or other sequence identifier).

CARM1-NTRK3 Fusion Polypeptides

In another embodiment, the CARM1-NTRK3 fusion polypeptide comprises an amino acid sequence (e.g., a fragment of the amino acid sequence) shown in FIG. 9 (SEQ ID NO: 8) and an amino acid sequence (e.g., a fragment of the amino acid sequence) shown in FIG. 11 (SEQ ID NO: 10), or a fragment of the fusion. In one embodiment, the CARM1-NTRK3 fusion polypeptide comprises an amino acid sequence substantially identical to the amino acid sequence (e.g., a fragment of the amino acid sequence) shown in FIG. 9 (SEQ ID NO: 8) and the amino acid sequence (e.g., a fragment of the amino acid sequence) shown in FIG. 11 (SEQ ID NO: 10), or a fragment thereof. In one embodiment, the CARM1-NTRK3 fusion polypeptide comprises an amino acid sequence at least 70%, 75%, 80%, 85%, 90%, 91%, 92%, 93%, 94%, 95%, 96%, 97%, 98%, 99%, or 99.5% identical to the amino acid sequence (e.g., a fragment of the amino acid sequence) shown in FIG. 9 (SEQ ID NO: 8) and the amino acid sequence (e.g., a fragment of the amino acid sequence) shown in FIG. 11 (SEQ ID NO: 10).

In one embodiment, the CARM1-NTRK3 fusion polypeptide comprises a sequence containing at least 10, 20, 50, 100, 500, 600, 700, 800, 900, 1000, or more amino acids of the amino acid sequences shown in FIG. 9 (SEQ ID NO: 8) and FIG. 11 (SEQ ID NO: 10) in combination. In one embodiment, the CARM1-NTRK3 fusion polypeptide comprises an amino acid sequence containing at least 5, 10, 20, 50, 100, 500, or more amino acids (e.g., contiguous amino acids) of the amino acid sequence shown in FIG. 9 (SEQ ID NO: 8) and at least 5, 10, 20, 50, 100, 500, 600, 700, or more amino acids (e.g., contiguous amino acids) of the amino acid sequence shown in FIG. 11 (SEQ ID NO: 10).

In one embodiment, the 5'-CARM1-NTRK3-3' fusion polypeptide includes an NTRK3 receptor tyrosine kinase domain or a functional fragment thereof. In an embodiment, the 5'-CARM1-NTRK3-3'fusion polypeptide comprises sufficient NTRK3 sequence and sufficient CARM1 sequence such that it has a kinase activity, e.g., has an elevated activity, e.g., an NTRK3 kinase activity, as compared with wildtype NTRK3, e.g., in a cell of a cancer described herein (e.g., a melanoma, e.g., a vaginal melanoma).

In yet other embodiments, the CARM1-NTRK3 fusion polypeptide comprises the amino acid sequence of SEQ ID NO: 12 (FIG. 13), or an amino acid sequence substantially identical thereto (e.g., at least 70%, 75%, 80%, 85%, 90%, 91%, 92%, 93%, 94%, 95%, 96%, 97%, 98%, 99%, or 99.5% identical to the amino acid sequence, or a fragment of the amino acid sequence).

In another aspect, the disclosure features a CARM1-NTRK3 fusion polypeptide (e.g., a purified CARM1-NTRK3 fusion polypeptide), a biologically active or antigenic fragment thereof, as well as reagents (e.g., antibody molecules that bind to a CARM1-NTRK3 fusion polypeptide), methods for modulating a CARM1-NTRK3 polypeptide activity, and detection of a CARM1-NTRK3 polypeptide.

In one embodiment, the CARM1-NTRK3 fusion polypeptide has at least one biological activity, e.g., an NTRK3 kinase activity and/or a methyl transferase activity. In one embodiment, at least one biological activity of the CARM1-NTRK3 fusion polypeptide is reduced or inhibited by an anti-cancer drug, e.g., a kinase inhibitor (e.g., a multikinase inhibitor or an NTRK3-specific inhibitor). Exemplary multikinase inhibitors include, e.g., KRC-108, crizotinib, and K252a. In one embodiment, at least one biological activity of the CARM1-NTRK3 fusion polypeptide is reduced or inhibited by an NTRK kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928. In certain embodiments, the NTRK kinase inhibitor is larotrectinib. In another embodiment, at least one biological activity of the CARM1-NTRK3 fusion polypeptide is reduced or inhibited by an anti-cancer drug, e.g., a methyl transferase inhibitor (e.g., a CARM1-specific inhibitor). In one embodiment, at least one biological activity of the CARM1-NTRK3 fusion polypeptide is reduced or inhibited by a methyl transferase inhibitor chosen from one or more of: EZM 2302 (EZM2302 or GSK 3359088); a PRMT4/CARM1 Inhibitor (e.g., 3,5-bis[(3-bromo-4-hydroxyphenyl)methylene]-1-(phenylmethyl)-4-piperidinone); or EPZ025654.

In yet other embodiments, the CARM1-NTRK3 fusion polypeptide is encoded by a nucleic acid molecule described herein. In one embodiment, the CARM1-NTRK3 fusion polypeptide is encoded by an in-frame fusion of intron 3 of CARM1 (e.g., a sequence on chromosome 15) with intron 2 of NTRK3 (e.g., a sequence on chromosome 19). In another embodiment, the CARM1-NTRK3 fusion polypeptide includes an amino acid sequence encoded by a nucleotide sequence comprising a fusion junction between the CARM1 transcript and the NTRK3 transcript.

In certain embodiments, the CARM1-NTRK3 fusion polypeptide comprises encoded exons 1-3 from CARM1 and one or more of encoded exons 3-19 of NTRK3. In certain embodiments, the CARM1-NTRK3 fusion polypeptide comprises at least 1, 2, or more encoded exons from CARM1 and at least 1, 2, 3, 4, 5, 6, 7, 8, 9, 10, 11, 12, 13, 14, 15, 16, or more, encoded exons from NTRK3. In certain embodiments, the CARM1-NTRK3 fusion polypeptide comprises a fusion of encoded exons 1-3 from CARM1 and encoded exons 3-19 from NTRK3 (or a fragment thereof). In certain embodiments, the CARM1-NTRK3 fusion polypeptide comprises encoded exons 1-3 from CARM1 and encoded exons 3-19 of NTRK3 (e.g., a fusion junction of the sequence of encoded exon 3 from CARM1 and the sequence of encoded exon 3 from NTRK3).

In certain embodiments, the CARM1-NTRK3 fusion comprises the amino acid sequence corresponding to exons 1-3 or a fragment thereof from CARM1 (e.g., as shown in FIG. 9 (SEQ ID NO: 8)), and the amino acid sequence corresponding to exons 3-19 or a fragment thereof from NTRK3 (e.g., as shown in FIG. 11 (SEQ ID NO: 10)). In one embodiment, the CARM1-NTRK3 fusion comprises at least 5, 10, 15, 20, or more amino acids from exons 1-3 of CARM1 (e.g., from the amino acid sequence of CARM1 preceding the fusion junction with NTRK3, e.g., of the CARM1 sequence shown in FIG. 9 (SEQ ID NO: 8)), and at least 5, 10, 15, 20, or more amino acids from exons 3-19 of NTRK3 (e.g., from the amino acid sequence of NTRK3 following the fusion junction with CARM1, e.g., of the NTRK3 sequence shown in FIG. 11 (SEQ ID NO: 10)).

In one embodiment, the CARM1-NTRK3 fusion polypeptide includes an NTRK3 tyrosine kinase domain or a functional fragment thereof. In a related aspect, the disclosure features CARM1-NTRK3 fusion polypeptides or fragments operatively linked to heterologous polypeptides to form fusion proteins.

In one embodiment, the CARM1-NTRK3 fusion polypeptide includes a CARM1 methyltransferase domain or a functional fragment thereof.

In another embodiment, the CARM1-NTRK3 fusion polypeptide or fragment is a peptide, e.g., an immunogenic peptide or protein that contains a fusion junction described herein. Such immunogenic peptides or proteins can be used to raise antibodies specific to a fusion protein. In other embodiments, such immunogenic peptides or proteins can be used for vaccine preparation. The vaccine preparation can include other components, e.g., an adjuvant.

In another aspect, the disclosure features antibody molecules that bind to a CARM1-NTRK3 fusion polypeptide or fragment described herein. In some embodiments, the antibody can distinguish wildtype NTRK3 (or CARM1) from a CARM1-NTRK3 fusion polypeptide described herein.

Additional NTRK1 Fusions

NTRK1 encodes the receptor tyrosine kinase TRKA, which regulates cell proliferation, differentiation, and survival of neurons by activating several downstream pathways that also play a role in tumorigenesis (e.g., GRB2-RAS-MAPK and RAS-PI3K-AKT1). NTRK1 fusions that include an N-terminal oligomerization-promoting partner gene linked to the kinase domain of TRKA have been characterized as activating, exhibiting constitutive kinase activity and tyrosine phosphorylation. The frequency of NTRK1 fusions is relatively low in common solid tumors and hematological malignancies (<5%) but is much higher in several rare solid tumors (>80%), such as infantile fibrosarcoma and cellular and mixed congenital mesoblastic nephroma (Penault-Llorca et al., 2019; 31072837).

Provided herein are NTRK1 gene fusion molecules that comprise all or part of a gene of Table A and all or part of NTRK1. NTRK1 gene fusion molecules described herein include any fusion molecule (e.g., gene, gene product (e.g., cDNA, mRNA, or polypeptide), and variant thereof) that includes a fragment of a gene of Table A or gene product of a gene of Table A and a fragment of an NTRK1 gene or gene product described herein, including, e.g., an NTRK1 fusion molecule of Tables C, D, and E. As shown in Table E, expression of NTRK1 fusion molecules described herein has been detected in cancer tissues, thus suggesting an association With cancer, e.g., a cancer of Table E.

TABLE A

Nucleotide Sequences of NTRK1 fusion partners.

| Gene | SEQ ID NO | Transcript ID |
|---|---|---|
| KIRREL1 | 17 | NM_018240 |
| CCDC88C | 18 | NM_001080414 |
| DCTN1 | 19 | NM_004082 |
| EML4 | 20 | NM_019063 |
| PRKAR1A | 21 | NM_002734 |
| PTPRC | 22 | NM_002838 |
| ARGLU1 | 23 | NM_018011 |
| MEX3A | 24 | NM_001093725 |
| SEL1L | 25 | NM_005065 |
| NAB2 | 26 | NM_005967 |
| DUSP10 | 27 | NM_007207 |
| NLGN1 | 28 | NM_014932 |
| DCST1 | 29 | NM_152494 |
| ACO1 | 30 | NM_002197 |
| EFNA3 | 31 | NM_004952 |
| CABLES1 | 32 | NM_138375 |
| RAB25 | 33 | NM_020387 |
| CUL4A | 34 | NM_001008895 |
| SEMA4B | 35 | NM_020210 |
| PTP4A2 | 36 | NM_080391 |
| ZBTB1 | 37 | NM_014950 |
| SMG5 | 38 | NM_015327 |
| SFPQ | 39 | NM_005066 |

TABLE A-continued

Nucleotide Sequences of NTRK1 fusion partners.

| Gene | SEQ ID NO | Transcript ID |
|---|---|---|
| NOS1AP | 40 | NM_014697 |
| BGLAP | 41 | NM_199173 |
| MEX3A | 1 | NM_001093725 |

TABLE B

Amino Acid Sequences of NTRK1 fusion partners.

| Gene | SEQ ID NO |
|---|---|
| KIRREL1 | 42 |
| CCDC88C | 43 |
| DCTN1 | 44 |
| EML4 | 45 |
| PRKAR1A | 46 |
| PTPRC | 47 |
| ARGLU1 | 48 |
| MEX3A | 49 |
| SEL1L | 50 |
| NAB2 | 51 |
| DUSP10 | 52 |
| NLGN1 | 53 |
| DCST1 | 54 |
| ACO1 | 55 |
| EFNA3 | 56 |
| CABLES1 | 57 |
| RAB25 | 58 |
| CUL4A | 59 |
| SEMA4B | 60 |
| PTP4A2 | 61 |
| ZBTB1 | 62 |
| SMG5 | 63 |
| SFPQ | 64 |
| NOS1AP | 65 |
| BGLAP | 66 |

TABLE C

Nucleotide Sequences of NTRK1 fusions.

| Fusion | 5' Transcript ID | Last exon of 5' transcript | 3' Transcript ID | First exon of 3' transcript | SEQ ID NO |
|---|---|---|---|---|---|
| KIRREL-NTRK1 | NM_018240 | 3 | NM_002529 | 8 | 67 |
| KIRREL-NTRK1 | NM_018240 | 11 | NM_002529 | 10 | 68 |
| CCDC88C-NTRK1 | NM_001080414 | 12 | NM_002529 | 12 | 69 |
| DCTN1-NTRK1 | NM_004082 | 26 | NM_002529 | 12 | 70 |
| EML4- NTRK1 | NM_019063 | 18 | NM_002529 | 12 | 71 |
| PRKAR1A-NTRK1 | NM_002734 | 8 | NM_002529 | 12 | 72 |
| PTPRC-NTRK1 | NM_002838 | 2 | NM_002529 | 8 | 73 |
| ARGLU1-NTRK1 | NM_018011 | 3 | NM_002529 | 11 | 74 |
| MEX3A-NTRK1 | NM_001093725 | 1 | NM_002529 | 9 | 75 |
| SEL1L- NTRK1 | NM_005065 | 1 | NM_002529 | 8 | 76 |
| NAB2- NTRK1 | NM_005967 | 5 | NM_002529 | 10 | 77 |
| NTRK1-DUSP10 | NM_002529 | 11 | NM_007207 | 3 | 78 |
| NTRK1-NLGN1 | NM_002529 | 7 | NM_014932 | 5 | 79 |
| NTRK1-DCST1 | NM_002529 | 3 | NM_152494 | 11 | 80 |
| MEX3A-NTRK1 | NM_001093725 | 1 | NM_002529 | 9 | 5 |

TABLE D

| Amino Acid Sequences of NTRK1 fusions. | |
|---|---|
| Fusion | SEQ ID NO |
| KIRREL- NTRK1 | 81 |
| KIRREL- NTRK1 | 82 |
| CCDC88C- NTRK1 | 83 |
| DCTN1- NTRK1 | 84 |
| EML4- NTRK1 | 85 |
| PRKAR1A- NTRK1 | 86 |
| PTPRC- NTRK1 | 87 |
| ARGLU1-NTRK1 | 88 |

TABLE D-continued

| Amino Acid Sequences of NTRK1 fusions. | |
|---|---|
| Fusion | SEQ ID NO |
| MEX3A- NTRK1 | 89 |
| SEL1L- NTRK1 | 90 |
| NAB2- NTRK1 | 91 |
| NTRK1- DUSP10 | 92 |
| NTRK1- NLGN1 | 93 |
| NTRK1- DCST1 | 94 |

TABLE E

| NTRK1 fusion breakpoints. | | | | |
|---|---|---|---|---|
| Fusion (5'-3') | Breakpoint 1 | Breakpoint 2 | Cancer Type | Rearrangement |
| KIRREL-NTRK1 | chr1: 158050567 | chr1: 156842050 | Unspecified primary serous carcinoma | Duplication; KIRREL(exons 1-3 NM_018240)-NTRK1(exons 8-17 NM_002529); breakpoints: KIRREL intron 3, NTRK1 intron 7. |
| KIRREL-NTRK1 | chr1: 158061720 | chr1: 156843904 | Soft tissue angiosarcoma | Fusion; KIRREL(exons 1-11 NM_018240)-NTRK1(exons 10-17 NM_002529); Reciprocal: no. |
| CCDC88C-NTRK1 | chr14: 91790206 | chr1: 156845277 | Colon adenocarcinoma (CRC) | chr14: chr1 translocation; CCDC88C(exons 1-12 NM_001080414)-NTRK1(exons 12-17 NM_002529); breakpoints: CCDC88C intron 12, NTRK1 intron 11. |
| DCTN1-NTRK1 | chr2: 74592202 | chr1: 156845312 | PEDIATRIC Soft tissue sarcoma (NOS) | Chr2: chr1 Translocation; DCTN1(exons 1-26 NM_004082)-NTRK1(exons 12-17 NM_002529): Reciprocal: no. |
| EML4-NTRK1 | chr2: 42543233 | chr1: 156845156 | Unknown primary adenocarcinoma | Chr2: chr1 Translocation; EML4(exons 1-18 NM_019063)-NTRK1(exons 12-17 NM_002529); breakpoints: EML4 intron 18, NTRK1 intron 11. |
| PRKAR1A-NTRK1 | chr17: 66524061 | chr1: 156844904 | Lung adenocarcinoma | Chr17: chr1 Translocation; PRKAR1A(exons 1-8 NM_002734)-NTRK1(exons 12-17 NM_002529); breakpoints: PRKAR1A intron 8, NTRK1 intron 11. |
| PTPRC-NTRK1 | chr1: 198634489 | chr1: 156841758 | Lung adenocarcinoma | Duplication; PTPRC(exons 1-2 NM_002838)-NTRK1(exons 8-17 NM_002529); breakpoints: PTPRC intron 2, NTRK1 intron 7. |
| ARGLU1-NTRK1 | chr13: 107196889 | chr1: 156844485 | Brain glioblastoma (GBM) | chr13: chr1 translocation; ARGLU1(exons 1-3 |

TABLE E-continued

NTRK1 fusion breakpoints.

| Fusion (5'-3') | Breakpoint 1 | Breakpoint 2 | Cancer Type | Rearrangement |
|---|---|---|---|---|
| | | | | NM_018011)-NTRK1(exons 11-17 NM_002529); breakpoints: ARGLU1 intron 3, NTRK1 intron 10. |
| MEX3A-NTRK1 | chr1: 156051072 | chr1: 156843781 | Ovary carcinosarcoma | Inversion; MEX3A(exons 1-1 NM_001093725)-NTRK1(exons 9-17 NM_002529); breakpoints: MEX3A intron 1, NTRK1 intron 8; Reciprocal: no. |
| SEL1L-NTRK1 | chr14: 81996404 | chr1: 156841878 | Pancreas acinar cell carcinoma | chr14: chr1 translocation; SEL1L(exons 1-1 NM_005065)-NTRK1(exons 8-17 NM_002529); breakpoints: SEL1L intron 1, NTRK1 intron 7. |
| NAB2-NTRK1 | chr12: 57486978 | chr1: 156844363 | Soft tissue liposarcoma | chr12: chr1 translocation; NAB2(exons 1-5 NM_005967)-NTRK1(exons 10-17 NM_002529); Reciprocal: no. |
| NTRK1-DUSP10 | chr1: 156845080 | chr1: 221901034 | Thyroid papillary carcinoma | Inversion; NTRK1(exons 1-11 NM_002529)-DUSP10(exons 3-4 NM_007207); breakpoints: NTRK1 intron 11, DUSP10 intron 2. |
| NTRK1-NLGN1 | chr1: 156842275 | chr3: 173545781 | Lung sarcomatoid carcinoma | chr1: chr3 translocation; NTRK1(exons 1-7 NM_002529)-NLGN1(exons 5-7 NM_014932); breakpoints: NTRK1 intron 7, NLGN1 intron 4. |
| NTRK1-DCST1 | chr1: 156834370-156834665 | chr1: 155016200-155016439 | Lung adenocarcinoma | Duplication; NTRK1(exons 1-3 NM_002529)-DCST1(exons 11-17 NM_152494); breakpoints: NTRK1 intron 3, DCST1 intron 10. |
| NTRK1-AC01 | chr1: 156812048 | chr9: 32426121 | Prostate acinar adenocarcinoma | chr1: chr9 translocation; NTRK1(exons 1-2 NM_001007792)-ACO1(exons 12-21 NM_002197); breakpoints: NTRK1 intron 2, ACO1 intron 11. |
| NTRK1-EFNA3 | chr1: 156785743 | chr1: 155056097 | Lung adenocarcinoma | Fusion; NTRK1(exon 1-exon 1 NM_001007792)-EFNA3(exons 2-ex5 NM_004952); breakpoints: NTRK1 intron 1, EFNA3 intron 1. |
| CABLES 1-NTRK1 | chr18: 20805274 | chr1: 156842301 | Ovary epithelial carcinoma (NOS) | chr18: chr1 translocation; CABLES1(exons 1-4 |

TABLE E-continued

| NTRK1 fusion breakpoints. | | | | |
|---|---|---|---|---|
| Fusion (5'-3') | Breakpoint 1 | Breakpoint 2 | Cancer Type | Rearrangement |
| | | | | NM_138375)-NTRK1(exons 8-17 NM_002529); breakpoints: CABLES 1 intron 4, NTRK1 intron 7. |
| NTRK1-RAB25 | chr1: 156844459 | chr1: 156032830 | Pancreas ductal adenocarcinoma | Duplication; NTRK1(exons 1-10 NM_002529)-RAB25(exons 2-5 NM_020387); breakpoints: NTRK1 intron 10, RAB25 intron 1. |
| CUL4A-NTRK1 | chr13: 113864171 | chr1: 156844377-156844417 | Soft tissue sarcoma (NOS) | chr13: chr1 translocation; CUL4A(exons 1-1 NM_001008895)-NTRK1(exons 10-17 NM_002529); breakpoints: CUL4A intron 1; FIGS. 31A-31B. |
| NTRK1-SEMA4B | chr1: 156843854 | chr15: 90730266 | Ovary serous carcinoma | chr1: chr15 translocation; NTRK1(exons 1-8 NM_002529)-SEMA4B(exons 2-15 NM_020210); breakpoints: NTRK1 intron 8, SEMA4B intron 1. |
| PTP4A2-NTRK1 | chr1: 32385259 | chr1: 156834146 | Soft tissue myxofibrosarcoma | Fusion; PTP4A2(exons 1-1 UTR NM_080391)-NTRK1(exons 3-17 NM_001007792); Reciprocal: no. |
| ZBTB1-NTRK1 | chr14: 64988205 | chr1: 156834146 | Unknown primary sarcoma (NOS) | chr14: chr1 translocation; ZBTB1(exons 1-1 UTR NM_014950)-NTRK1(exons 2-17 NM_002529); Reciprocal: no. |
| SMG5-NTRK1 | chr1: 156252489 | chr1: 156845817 | Prostate acinar adenocarcinoma | Inversion; SMG5(exons 1-1 NM_015327)-NTRK1(exons 13-17 NM_002529); breakpoints: SMG5 exon 1,NTRK1 intron 12. |
| SFPQ-NTRK1 | chr1: 35650140 | chr1: 156844231 | Lung adenocarcinoma | Inversion; SFPQ(exons 1-10 UTR NM_005066)-NTRK1(exons 9-17 NM_002529); breakpoints SFPQ exon 10, NTRK1 intron 8. Reciprocal: Yes. |
| NOS1AP-NTRK1 | chr1: 162337088 | chr1: 156843914 | PEDIATRIC Brain glioblastoma (GBM) | Duplication; NOS1AP(exons 1-10 UTR NM_014697)-NTRK1(exons 9-17 NM_002529); breakpoints: NOS1AP exon 10, NTRK1 intron 8; FIGS. 32A-32B |
| NTRK1-BGLAP | chr1: 156845233 | chr1: 156211955 | Lung adenocarcinoma | Duplication; NTRK1(exons 1-11 NM_002529)-BGLAP(exons 2-4 NM_199173); |

TABLE E-continued

| NTRK1 fusion breakpoints. | | | | |
|---|---|---|---|---|
| Fusion (5'-3') | Breakpoint 1 | Breakpoint 2 | Cancer Type | Rearrangement |
| | | | | breakpoints: NTRK1 intron 11, BGLAP exon 1; FIGS. 33A-33B |
| MEX3A-NTRK1 | 156843777-156843890 on Chromosome 1 | 156051070-156051319 on Chromosome 1 | Ovarian carcinosarcoma | Inversion. |

In one embodiment, the NTRK1 fusion molecule includes an in-frame fusion of an exon of a gene of Table A, e.g., one more exons of a gene of Table A (e.g., as described in Tables C or E) or a fragment thereof, and one or more exons of NTRK1, e.g., one or more exons of an NTRK1 gene (e.g., FIG. 4 (SEQ ID NO: 3), FIG. 36A (SEQ ID NO: 186), or FIG. 36B (SEQ ID NO: 187)) or a fragment thereof, e.g., as described in Tables C or E. In some embodiments, the NTRK1 fusion molecule includes all or part of at least one exon of a nucleotide sequence of any of SEQ ID NOs: 1 or 17-41, or of a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In some embodiments, the NTRK1 fusion molecule includes all or part of at least one exon of a Transcript ID shown in Tables A, C, or E or of a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto).

In some embodiments, the NTRK1 fusion molecule comprises an in-frame fusion of an exon provided in the "Last exon of 5' transcript" column of Table C with an exon provided in the "First exon of 3' transcript" column of Table C.

In another embodiment, the fusion molecule includes the nucleotide sequence of any one of SEQ ID NOs: 5 or 67-80, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion molecule encodes the amino acid sequence of any one of SEQ ID NOs: 81-94, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In some embodiments, the NTRK1 fusion molecule can include an in-frame fusion within an intron of a gene of Table A (e.g., as described in Tables C or E) or a fragment thereof, with an intron of NTRK1 (e.g., as described in Tables C or E) or a fragment thereof. In some embodiments, the NTRK1 fusion comprises a Breakpoint 1 and/or a Breakpoint 2 of Table E. In some embodiments, the NTRK1 fusion comprises a rearrangement of Table E. In some embodiments, the NTRK1 fusion is a rearrangement described in Table E.

The term "fusion" or "fusion molecule" can refer to a fusion polypeptide or a fusion nucleic acid/fusion nucleic acid molecule, depending on the context. It may include a full-length sequence of a fusion or a fragment thereof, e.g., a fragment comprising a fusion junction (e.g., a fragment including a portion of a gene of Table A and a portion of NTRK1, e.g., a portion of an NTRK1 fusion molecule described herein, e.g., as described in Table C). In one embodiment, an NTRK1 fusion polypeptide includes a fragment of the amino acid sequence of SEQ ID NO: 4 (e.g., as shown in FIG. 5), SEQ ID NO: 188 (e.g., as shown in FIG. 36C), or SEQ ID NO: 189 (e.g., as shown in FIG. 36D), or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto) and a fragment of the amino acid sequence of any one of SEQ ID NOs: 42-66, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the NTRK1 fusion polypeptide includes the amino acid sequence of any one of SEQ ID NOs: 81-94, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In another embodiment, the NTRK1 fusion nucleic acid molecule includes a fragment of a nucleotide sequence of Table A and a fragment of the nucleotide sequence shown in FIG. 4 (SEQ ID NO: 3), FIG. 36A (SEQ ID NO: 186), or FIG. 36B (SEQ ID NO: 187), or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes the nucleotide sequence of any one of SEQ ID NOs: 5 or 67-80, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion nucleic acid molecule includes a nucleotide sequence encoding the amino acid sequence of any one of SEQ ID NOs: 81-94, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the NTRK1 fusion polypeptide comprises sufficient sequence of an amino acid sequence of Table B (e.g., any one of SEQ ID NOs: 42-66) and sufficient NTRK1 sequence (e.g., of FIG. 5 or SEQ ID NO: 4, FIG. 36C or SEQ ID NO: 188, or FIG. 36D or SEQ ID NO: 189) such that the fusion (e.g., a fusion of Table D, e.g., comprising the sequence of any one of SEQ ID NOs: 81-94) has a kinase activity, e.g., has an elevated (e.g., constitutive) activity, e.g., an NTRK1 tyrosine kinase activity, e.g., a TRKA kinase activity, as compared with wildtype NTRK1, e.g., in a cell of a cancer described to herein (e.g., a cancer described herein or provided in Table E).

In some embodiments, the NTRK1 fusion comprises a fusion shown in Table C, wherein the genes in the Fusion are provided in the 5' to 3' direction. In some embodiments, the NTRK1 fusion comprises any of at least 1, at least 5, at least 10, at least 15, at least 20, at least 25, at least 30, at least 40, at least 50, or more amino acids of an exon shown in the "Last exon of 5' transcript" column of Table C, and any of at least 1, at least 5, at least 10, at least 15, at least 20, at least 25, at least 30, at least 40, at least 50, or more amino acids of an exon shown in the "First exon of 3' transcript" column of Table C.

In some embodiments, the NTRK1 fusion comprises a fusion shown in Table C, wherein the genes in the Fusion are provided in the 5' to 3' direction. In some embodiments, the NTRK1 fusion comprises any of at least 3, at least 6, at least 12, at least 15, at least 20, at least 25, at least 50, at least 75, at least 100, or more nucleotides of an exon shown in the "Last exon of 5' transcript" column of Table C, and any of at least 3, at least 6, at least 12, at least 15, at least 20, at least 25, at least 50, at least 75, at least 100, or more nucleotides of an exon shown in the "First exon of 3' transcript" column of Table C.

In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of KIRREL1 (e.g., having the nucleotide sequence of SEQ ID NO: 17 or of Transcript ID NM_018240, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of CCDC88C (e.g., having the nucleotide sequence of SEQ ID NO: 18 or of Transcript ID NM_001080414, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of DCTN1 (e.g., having the nucleotide sequence of SEQ ID NO: 19 or of Transcript ID NM_004082, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of EML4 (e.g., having the nucleotide sequence of SEQ ID NO: 20 or of Transcript ID NM_019063, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of PRKAR1A (e.g., having the nucleotide sequence of SEQ ID NO: 21 or of Transcript ID NM_002734, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of PTPRC (e.g., having the nucleotide sequence of SEQ ID NO: 22 or of Transcript ID NM_002838, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of ARGLU1 (e.g., having the nucleotide sequence of SEQ ID NO: 23 or of Transcript ID NM_018011, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of MEX3A (e.g., having the nucleotide sequence of SEQ ID NO: 24 or of Transcript ID NM_001093725, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of SEL1L (e.g., having the nucleotide sequence of SEQ ID NO: 25 or of Transcript ID NM_005065, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of NAB2 (e.g., having the nucleotide sequence of SEQ ID NO: 26 or of Transcript ID NM_005967, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of DUSP10 (e.g., having the nucleotide sequence of SEQ ID NO: 27 or of Transcript ID NM_007207, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of NLGN1 (e.g., having the nucleotide sequence of SEQ ID NO: 28 or of Transcript ID NM_014932, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of DCST1 (e.g., having the nucleotide sequence of SEQ ID NO: 29 or of Transcript ID NM_152494, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of ACO1 (e.g., having the nucleotide sequence of SEQ ID NO: 30 or of Transcript ID NM_002197, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of EFNA3 (e.g., having the nucleotide sequence of SEQ ID NO: 31 or of Transcript ID NM_004952, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of CABLES1 (e.g., having the nucleotide sequence of SEQ ID NO: 32 or of Transcript ID NM_138375, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of RAB25 (e.g., having the nucleotide sequence of SEQ ID NO: 33 or of Transcript ID NM_020387, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of CUL4A (e.g., having the nucleotide sequence of SEQ ID NO: 34 or of Transcript ID NM_001008895, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of SEMA4B (e.g., having the nucleotide sequence of SEQ ID NO: 35 or of Transcript ID NM_020210, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of PTP4A2 (e.g., having the nucleotide sequence of SEQ ID NO: 36 or of Transcript ID NM_080391, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of ZBTB1 (e.g., having the nucleotide sequence of SEQ ID NO: 37 or of Transcript ID NM_014950, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of SMG5 (e.g., having the nucleotide sequence of SEQ ID NO: 38 or of Transcript ID NM_015327, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of SFPQ (e.g., having the nucleotide sequence of SEQ ID NO: 39 or of Transcript ID NM_005066, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of NOS1AP (e.g., having the nucleotide sequence of SEQ ID NO: 40 or of Transcript ID NM_014697, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of all or a part of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and all or a part of BGLAP (e.g., having the nucleotide sequence of SEQ ID NO: 41 or of Transcript ID NM_199173, or a nucleotide sequence at least 70%, 75%, 80%, 85%, 90%, 91%, 92%, 93%, 94% 95%, 96%, 97%, 98%, 99%, or 99.5% identical thereto).

In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of KIRREL1 (e.g., having the nucleotide sequence of SEQ ID NO: 17 or of Transcript ID NM_018240, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of CCDC88C (e.g., having the nucleotide sequence of SEQ ID NO: 18 or of Transcript ID NM_001080414, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of DCTN1 (e.g., having the nucleotide sequence of SEQ ID NO: 19 or of Transcript ID NM_004082, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of EML4 (e.g., having the nucleotide sequence of SEQ ID NO: 20 or of Transcript ID NM_019063, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of PRKAR1A (e.g., having the nucleotide sequence of SEQ ID NO: 21 or of Transcript ID NM_002734, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of PTPRC (e.g., having the nucleotide sequence of SEQ ID NO: 22 or of Transcript ID NM_002838, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of ARGLU1 (e.g., having the nucleotide sequence of SEQ ID NO: 23 or of Transcript ID NM_018011, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of MEX3A (e.g., having the nucleotide sequence of SEQ ID NO: 24 or of Transcript ID NM_001093725, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of SEL1L (e.g., having the nucleotide sequence of SEQ ID NO: 25 or of Transcript ID NM_005065, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of NAB2 (e.g., having the nucleotide sequence of SEQ ID NO: 26 or of Transcript ID NM_005967, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of DUSP10 (e.g., having the nucleotide sequence of SEQ ID NO: 27 or of Transcript ID NM_007207, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of NLGN1 (e.g., having the nucleotide sequence of SEQ ID NO: 28 or of Transcript ID NM_014932, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of DCST1 (e.g., having the nucleotide sequence of SEQ ID NO: 29 or of Transcript ID NM_152494, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of ACO1 (e.g., having the nucleotide sequence of SEQ ID NO: 30 or of Transcript ID NM_002197, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of EFNA3 (e.g., having the nucleotide sequence of SEQ ID NO: 31 or of Transcript ID NM_004952, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of CABLES1 (e.g., having the nucleotide sequence of SEQ ID NO: 32 or of Transcript ID NM_138375, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of RAB25 (e.g., having the nucleotide sequence of SEQ ID NO: 33 or of Transcript ID NM_020387, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of CUL4A (e.g., having the nucleotide sequence of SEQ ID NO: 34 or of Transcript ID NM_001008895, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of SEMA4B (e.g., having the nucleotide sequence of SEQ ID NO: 35 or of Transcript ID NM_020210, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of PTP4A2 (e.g., having the nucleotide sequence of SEQ ID NO: 36 or of Transcript ID NM_080391, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of ZBTB1 (e.g., having the nucleotide sequence of SEQ ID NO: 37 or of Transcript ID NM_014950, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of SMG5 (e.g., having the nucleotide sequence of SEQ ID NO: 38 or of Transcript ID NM_015327, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of SFPQ (e.g., having the nucleotide sequence of SEQ ID NO: 39 or of Transcript ID NM_005066, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of NOS1AP (e.g., having the nucleotide sequence of SEQ ID NO: 40 or of Transcript ID NM_014697, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK1 fusion provided herein comprises a fusion of one or more exons of an NTRK1 gene (e.g., an NTRK1 gene provided herein, e.g., having a nucleotide sequence of any of SEQ ID NOs: 3, 186, or 187, or a nucleotide sequence at least 70%, 75%, 80%, 85%, 90%, 91%, 92%, 93%, 94% 95%, 96%, 97%, 98%, 99%, or 99.5% identical thereto) and one or more exons of BGLAP (e.g., having the nucleotide sequence of SEQ ID NO: 41 or of Transcript ID NM_199173, or a nucleotide sequence at least 70%, 75%, 80%, 85%, 90%, 91%, 92%, 93%, 94% 95%, 96%, 97%, 98%, 99%, or 99.5% identical thereto).

In some embodiments, a KIRREL-NTRK1 fusion provided herein comprises the nucleotide sequence of SEQ ID NO: 67, or a nucleotide sequence at least 70%, 75%, 80%, 85%, 90%, 91%, 92%, 93%, 94% 95%, 96%, 97%, 98%, 99%, or 99.5% identical thereto. In some embodiments, a KIRREL-NTRK1 fusion provided herein comprises the nucleotide sequence of SEQ ID NO: 68, or a nucleotide sequence at least 70%, 75%, 80%, 85%, 90%, 91%, 92%, 93%, 94% 95%, 96%, 97%, 98%, 99%, or 99.5% identical thereto. In some embodiments, a CCDC88C-NTRK1 fusion provided herein comprises the nucleotide sequence of SEQ ID NO: 69, or a nucleotide sequence at least 70%, 75%, 80%, 85%, 90%, 91%, 92%, 93%, 94% 95%, 96%, 97%, 98%, 99%, or 99.5% identical thereto. In some embodiments, a DCTN1-NTRK1 fusion provided herein comprises the nucleotide sequence of SEQ ID NO: 70, or a nucleotide sequence at least 70%, 75%, 80%, 85%, 90%, 91%, 92%, 93%, 94% 95%, 96%, 97%, 98%, 99%, or 99.5% identical thereto. In some embodiments, an EML4-NTRK1 fusion provided herein comprises the nucleotide sequence of SEQ ID NO: 71, or a nucleotide sequence at least 70%, 75%, 80%, 85%, 90%, 91%, 92%, 93%, 94% 95%, 96%, 97%, 98%, 99%, or 99.5% identical thereto. In some embodiments, a PRKAR1A-NTRK1 fusion provided herein comprises the nucleotide sequence of SEQ ID NO: 72, or a nucleotide sequence at least 70%, 75%, 80%, 85%, 90%, 91%, 92%, 93%, 94% 95%, 96%, 97%, 98%, 99%, or 99.5% identical thereto. In some embodiments, a PTPRC-NTRK1 fusion provided herein comprises the nucleotide sequence of SEQ ID NO: 73, or a nucleotide sequence at least 70%, 75%, 80%, 85%, 90%, 91%, 92%, 93%, 94% 95%, 96%, 97%, 98%, 99%, or 99.5% identical thereto. In some embodiments, an ARGLU1-NTRK1 fusion provided herein comprises the nucleotide sequence of SEQ ID NO: 74, or a nucleotide sequence at least 70%, 75%, 80%, 85%, 90%, 91%, 92%, 93%, 94% 95%, 96%, 97%, 98%, 99%, or 99.5% identical thereto. In some embodiments, a MEX3A-NTRK1 fusion provided herein comprises the nucleotide sequence of SEQ ID NO: 75, or a nucleotide sequence at least 70%, 75%, 80%, 85%, 90%, 91%, 92%, 93%, 94% 95%, 96%, 97%, 98%, 99%, or 99.5% identical thereto. In some embodiments, a SEL1L-NTRK1 fusion provided herein comprises the nucleotide sequence of SEQ ID NO: 76, or a nucleotide sequence at least 70%, 75%, 80%, 85%, 90%, 91%, 92%, 93%, 94% 95%, 96%, 97%, 98%, 99%, or 99.5% identical thereto. In some embodiments, a NAB2-NTRK1 fusion provided herein comprises the nucleotide sequence of SEQ ID NO: 77, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK1-DUSP10 fusion provided herein comprises the nucleotide sequence of SEQ ID NO: 78, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK1-NLGN1 fusion provided herein comprises the nucleotide sequence of SEQ ID NO: 79, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK1-DCST1 fusion provided herein comprises the nucleotide sequence of SEQ ID NO: 80, or a nucleotide sequence at least 70%, 75%, 80%, 85%, 90%, 91%, 92%, 93%, 94% 95%, 96%, 97%, 98%, 99%, or 99.5% identical thereto.

In some embodiments, a KIRREL-NTRK1 fusion provided herein comprises a nucleotide sequence encoding an amino acid sequence of SEQ ID NO: 81, or a nucleotide sequence at least 70%, 75%, 80%, 85%, 90%, 91%, 92%, 93%, 94% 95%, 96%, 97%, 98%, 99%, or 99.5% identical thereto. In some embodiments, a KIRREL-NTRK1 fusion provided herein comprises a nucleotide sequence encoding an amino acid sequence of SEQ ID NO: 82, or a nucleotide sequence at least 70%, 75%, 80%, 85%, 90%, 91%, 92%, 93%, 94% 95%, 96%, 97%, 98%, 99%, or 99.5% identical thereto. In some embodiments, a CCDC88C-NTRK1 fusion provided herein comprises a nucleotide sequence encoding an amino acid sequence of SEQ ID NO: 83, or a nucleotide sequence at least 70%, 75%, 80%, 85%, 90%, 91%, 92%, 93%, 94% 95%, 96%, 97%, 98%, 99%, or 99.5% identical thereto. In some embodiments, a DCTN1-NTRK1 fusion provided herein comprises a nucleotide sequence encoding an amino acid sequence of SEQ ID NO: 84, or a nucleotide sequence at least 70%, 75%, 80%, 85%, 90%, 91%, 92%, 93%, 94% 95%, 96%, 97%, 98%, 99%, or 99.5% identical thereto. In some embodiments, an EML4-NTRK1 fusion provided herein comprises a nucleotide sequence encoding an amino acid sequence of SEQ ID NO: 85, or a nucleotide sequence at least 70%, 75%, 80%, 85%, 90%, 91%, 92%, 93%, 94% 95%, 96%, 97%, 98%, 99%, or 99.5% identical thereto. In some embodiments, a PRKAR1A-NTRK1 fusion provided herein comprises a nucleotide sequence encoding an amino acid sequence of SEQ ID NO: 86, or a nucleotide sequence at least 70%, 75%, 80%, 85%, 90%, 91%, 92%, 93%, 94% 95%, 96%, 97%, 98%, 99%, or 99.5% identical thereto. In some embodiments, a PTPRC-NTRK1 fusion provided herein comprises a nucleotide sequence encoding an amino acid sequence of SEQ ID NO: 87, or a nucleotide sequence at least 70%, 75%, 80%, 85%, 90%, 91%, 92%, 93%, 94% 95%, 96%, 97%, 98%, 99%, or 99.5% identical thereto. In some embodiments, an ARGLU1-NTRK1 fusion provided herein comprises a nucleotide sequence encoding an amino acid sequence of SEQ ID NO: 88, or a nucleotide sequence at least 70%, 75%, 80%, 85%, 90%, 91%, 92%, 93%, 94% 95%, 96%, 97%, 98%, 99%, or 99.5% identical thereto. In some embodiments, a MEX3A-NTRK1 fusion provided herein comprises a nucleotide sequence encoding an amino acid sequence of SEQ ID NO: 89, or a nucleotide sequence at least 70%, 75%, 80%, 85%, 90%, 91%, 92%, 93%, 94% 95%, 96%, 97%, 98%, 99%, or 99.5% identical thereto. In some embodiments, a SEL1L-NTRK1 fusion provided herein comprises a nucleotide sequence encoding an amino acid sequence of SEQ ID NO: 90, or a nucleotide sequence at least 70%, 75%, 80%, 85%, 90%, 91%, 92%, 93%, 94% 95%, 96%, 97%, 98%, 99%, or 99.5% identical thereto. In some embodiments, a NAB2-NTRK1 fusion provided herein comprises a nucleotide sequence encoding an amino acid sequence of SEQ ID NO: 91, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK1-DUSP10 fusion provided herein comprises a nucleotide sequence encoding an amino acid sequence of SEQ ID NO: 92, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK1-NLGN1 fusion provided herein comprises a nucleotide sequence encoding an amino acid sequence of SEQ ID NO: 93, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK1-DCST1 fusion provided herein comprises a nucleotide sequence encoding an amino acid sequence of SEQ ID NO: 94, or a nucleotide sequence at least 70%, 75%, 80%, 85%, 90%, 91%, 92%, 93%, 94% 95%, 96%, 97%, 98%, 99%, or 99.5% identical thereto.

In some embodiments, a KIRREL-NTRK1 fusion provided herein comprises, in the 5' to 3' direction, a Breakpoint 1 of chr1:158050567 and a Breakpoint 2 of chr1:156842050. In some embodiments, a KIRREL-NTRK1 fusion provided herein comprises, in the 5' to 3' direction, a Breakpoint 1 of chr1:158061720 and a Breakpoint 2 of chr1:156843904. In some embodiments, a CCDC88C-NTRK1 fusion provided herein comprises, in the 5' to 3' direction, a Breakpoint 1 of chr14:91790206 and a Breakpoint 2 of chr1:156845277. In some embodiments, a DCTN1-NTRK1 fusion provided herein comprises, in the 5' to 3' direction, a Breakpoint 1 of chr2:74592202 and a Breakpoint 2 of chr1:156845312. In some embodiments, an EML4-NTRK1 fusion provided herein comprises, in the 5' to 3' direction, a Breakpoint 1 of chr2:42543233 and a Breakpoint 2 of chr1:156845156. In some embodiments, a PRKAR1A-NTRK1 fusion provided herein comprises, in the 5' to 3' direction, a Breakpoint 1 of chr17:66524061 and a Breakpoint 2 of chr1:156844904. In some embodiments, a PTPRC-NTRK1 fusion provided herein comprises, in the 5' to 3' direction, a Breakpoint 1 of chr1:198634489 and a Breakpoint 2 of chr1:156841758. In some embodiments, an ARGLU1-NTRK1 fusion provided herein comprises, in the 5' to 3' direction, a Breakpoint 1 of chr13:107196889 and a Breakpoint 2 of chr1:156844485. In some embodiments, a MEX3A-NTRK1 fusion provided herein comprises, in the 5' to 3' direction, a Breakpoint 1 of chr1:156051072 and a Breakpoint 2 of chr1:156843781. In some embodiments, a SEL1L-NTRK1 fusion provided herein comprises, in the 5' to 3' direction, a Breakpoint 1 of chr14:81996404 and a Breakpoint 2 of chr1:156841878. In some embodiments, a NAB2-NTRK1 fusion provided herein comprises, in the 5' to 3' direction, a Breakpoint 1 of chr12:57486978 and a Breakpoint 2 of chr1:156844363. In some embodiments, a NTRK1-DUSP10 fusion provided herein comprises, in the 5' to 3' direction, a Breakpoint 1 of chr1:156845080 and a Breakpoint 2 of chr1:221901034. In some embodiments, a NTRK1-NLGN1 fusion provided herein comprises, in the 5' to 3' direction, a Breakpoint 1 of chr1:156842275 and a Breakpoint 2 of chr3:173545781. In some embodiments, a NTRK1-DCST1 fusion provided herein comprises, in the 5' to 3' direction, a Breakpoint 1 of chr1:156834370-156834665 and a Breakpoint 2 of chr1: 155016200-155016439. In some embodiments, a NTRK1-ACO1 fusion provided herein comprises, in the 5' to 3' direction, a Breakpoint 1 of chr1:156812048 and a Breakpoint 2 of chr9:32426121. In some embodiments, a NTRK1-EFNA3 fusion provided herein comprises, in the 5' to 3' direction, a Breakpoint 1 of chr1:156785743 and a Breakpoint 2 of chr1:155056097. In some embodiments, a CABLES1-NTRK1 fusion provided herein comprises, in the 5' to 3' direction, a Breakpoint 1 of chr18:20805274 and a Breakpoint 2 of chr1:156842301. In some embodiments, a NTRK1-RAB25 fusion provided herein comprises, in the 5' to 3' direction, a Breakpoint 1 of chr1:156844459 and a Breakpoint 2 of chr1:156032830. In some embodiments, a CUL4A-NTRK1 fusion provided herein comprises, in the 5' to 3' direction, a Breakpoint 1 of chr13:113864171 and a Breakpoint 2 of chr1:156844377-156844417. In some embodiments, a NTRK1-SEMA4B fusion provided herein comprises, in the 5' to 3' direction, a Breakpoint 1 of chr1:156843854 and a Breakpoint 2 of chr15:90730266. In some embodiments, a PTP4A2-NTRK1 fusion provided herein comprises, in the 5' to 3' direction, a Breakpoint 1 of chr1:32385259 and a Breakpoint 2 of chr1:156834146. In some embodiments, a ZBTB1-NTRK1 fusion provided herein comprises, in the 5' to 3' direction, a Breakpoint 1 of chr14:64988205 and a Breakpoint 2 of chr1:156834146. In some embodiments, a SMG5-NTRK1 fusion provided herein comprises, in the 5' to 3' direction, a Breakpoint 1 of chr1:156252489 and a Breakpoint 2 of chr1:156845817. In some embodiments, a SFPQ-NTRK1 fusion provided herein comprises, in the 5' to 3' direction, a Breakpoint 1 of chr1:35650140 and a Breakpoint 2 of chr1:156844231. In some embodiments, a NOS1AP-NTRK1 fusion provided herein comprises, in the 5' to 3' direction, a Breakpoint 1 of chr1:162337088 and a Breakpoint 2 of chr1:156843914. In some embodiments, a NTRK1-BGLAP fusion provided herein comprises, in the 5' to 3' direction, a Breakpoint 1 of chr1:156845233 and a Breakpoint 2 of chr1:156211955.

NTRK1 Fusion Nucleic Acid Molecules

In one aspect, provided herein are nucleic acid molecules (e.g., an isolated or purified nucleic acid molecule) that comprising a fragment of a gene of Table A and a fragment of an NTRK1 gene. In one embodiment, the fusion nucleic acid molecule includes a nucleotide sequence encoding an NTRK1 fusion polypeptide provided herein (e.g., as shown in Table D) that includes an NTRK1 tyrosine kinase domain or a functional fragment thereof, e.g., a TRKA kinase domain or a functional fragment thereof. In other embodiments, the fusion nucleic acid molecule includes a nucleotide sequence encoding a fragment of a polypeptide of Table B or a fragment thereof or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding a fragment of a polypeptide of any one of SEQ ID NOs: 42-66 or a fragment thereof or a sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes a nucleotide sequence encoding a fragment of the NTRK1 polypeptide including the amino acid sequence of any one of SEQ ID NOs: 4, 188, or 189, or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding an amino acid sequence provided in Table B (e.g., any one of SEQ ID NOs: 42-66), or a fragment thereof, and the amino acid sequence shown in FIG. 5 (SEQ ID NO: 4), FIG. 36C (SEQ ID NO: 188), or FIG. 36D (SEQ ID NO: 189), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding an amino acid sequence provided in Table D (e.g., any one of SEQ ID NOs: 81-94), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the NTRK1 nucleic acid molecule includes a fusion, e.g., resulting in an in-frame fusion, between an intron of a gene of Table A (e.g., as described in Tables C or E) and an intron of NTRK1 (e.g., as described in Tables C or E). In some embodiments, the NTRK1 fusion nucleic acid molecule comprises a Breakpoint 1 and/or a Breakpoint 2 provided in Table E. In some embodiments, the NTRK1 fusion nucleic acid molecule comprises a rearrangement provided in Table E.

In another embodiment, the NTRK1 fusion nucleic acid molecule comprises a nucleotide sequence (e.g., a fragment of a nucleotide sequence) shown in Table A (e.g., any one of SEQ ID NOs: 1 or 17-41) and a nucleotide sequence (e.g., a fragment of a nucleotide sequence) shown in FIG. 4 (SEQ ID NO: 3), FIG. 36A (SEQ ID NO: 186), or FIG. 36B (SEQ ID NO: 187), or a fragment of the fusion nucleic acid molecule. In one embodiment, the NTRK1 fusion nucleic acid molecule comprises a nucleotide sequence substantially identical to a nucleotide sequence (e.g., a fragment of a nucleotide sequence) shown in Table A (e.g., any one of SEQ ID NOs: 1 or 17-41) and a nucleotide sequence substantially identical to the nucleotide sequence (e.g., a fragment of a nucleotide sequence) shown FIG. 4 (SEQ ID NO: 3), FIG. 36A (SEQ ID NO: 186), or FIG. 36B (SEQ ID NO: 187). In another embodiment, the NTRK1 fusion nucleic acid molecule comprises a nucleotide sequence (e.g., a fragment of a nucleotide sequence) shown in Table C (e.g., any one of SEQ ID NOs: 5 or 67-80), or a fragment thereof. In one embodiment, the NTRK1 fusion nucleic acid molecule comprises a nucleotide sequence substantially identical to a nucleotide sequence (e.g., a fragment of a nucleotide sequence) shown in Table C (e.g., any one of SEQ ID NOs: 5 or 67-80), or a fragment thereof.

In one embodiment, the NTRK1 fusion nucleic acid molecule comprises a nucleotide sequence at least 70%, 75%, 80%, 85%, 90%, 91%, 92%, 93%, 94%, 95%, 96%, 97%, 98%, 99%, or 99.5% identical to a nucleotide sequence (e.g., a fragment of a nucleotide sequence) provided in Table A (e.g., any one of SEQ ID NOs: 1 or 17-41) and to the nucleotide sequence (e.g., a fragment of a nucleotide sequence) shown in FIG. 4 (SEQ ID NO: 3), FIG. 36A (SEQ ID NO: 186), or FIG. 36B (SEQ ID NO: 187). In yet other embodiments, the NTRK1 fusion nucleic acid molecule comprises A nucleotide sequence of Table C (e.g., any one of SEQ ID NOs: 5 or 67-80), or a fragment thereof, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical to the nucleotide sequence, or a fragment of a nucleotide sequence). In one embodiment, the NTRK1 fusion nucleic acid molecule comprises a nucleotide sequence containing at least 25, 50, 100, 150, 200, 500, 1000, 1500, 2000, 2500, 3000, 4000, 5000, 6000, or more nucleotides of a nucleotide sequence shown in Table A (e.g., any one of SEQ ID NOs: 1 or 17-41) and a nucleotide sequence containing at least 25, 50, 100, 150, 200, 500, 1000, 1500, 2000, 2500, or more nucleotides of the nucleotide sequence shown in FIG. 4 (SEQ ID NO: 3), FIG. 36A (SEQ ID NO: 186), or FIG. 36B (SEQ ID NO: 187). In one embodiment, the NTRK1 fusion nucleic acid molecule comprises a nucleotide sequence containing at least 25, 50, 100, 150, 200, 500, 1000, 1500, 2000, 2500, 3000, 4000, 5000, 6000, or more nucleotides (e.g., contiguous nucleotides) of a nucleotide sequence shown in Table A (e.g., any one of SEQ ID NOs: 1 or 17-41) and a nucleotide sequence containing at least 25, 50, 100, 150, 200, 500, 1000, 1500, 2000, 2500, or more nucleotides of the nucleotide sequence shown in FIG. 4 (SEQ ID NO: 3), FIG. 36A (SEQ ID NO: 186), or FIG. 36B (SEQ ID NO: 187).

In another embodiment, the nucleic acid molecule includes a fusion, e.g., resulting in an in-frame fusion, of at least one exon of a gene (or of a Transcript ID) provided in Table A or a fragment thereof and at least one exon or a fragment thereof of NTRK1 or a fragment thereof. In yet other embodiments, the nucleic acid molecule includes a fragment of a nucleotide sequence shown in Table A (e.g., any one of SEQ ID NOs: 1 or 17-41) and a fragment of the nucleotide sequence shown in FIG. 4 (SEQ ID NO: 3), FIG. 36A (SEQ ID NO: 186), or FIG. 36B (SEQ ID NO: 187), or a sequence substantially identical thereto (e.g., at least 70%, 75%, 80%, 85%, 90%, 91%, 92%, 93%, 94%, 95%, 96%, 97%, 98%, 99%, or 99.5% identical thereto), or a nucleotide sequence shown in Table C (e.g., any one of SEQ ID NOs: 5 or 67-80), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the nucleic acid molecule is complementary to at least a portion of a nucleotide sequence disclosed herein, e.g., is capable of hybridizing under a stringency condition described herein to a nucleotide sequence of any one of SEQ ID NO: 3, 186, or 187 and/or to a nucleotide sequence provided in Table A or Table C (e.g., any one of SEQ ID NOs: 1 or 17-41 or 5 or 67-80), or a fragment of any of the aforesaid nucleic acid sequences. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence of any one of SEQ ID NO: 3, 186, or 187 and/or to a nucleotide sequence provided in Table A or Table C (e.g., any one of SEQ ID NOs: 1 or 17-41 or 5 or 67-80), or a fragment thereof. The nucleotide sequence of a cDNA encoding exemplary NTRK1 fusions are shown in Table C (e.g., any one of SEQ ID NOs: 5 or 67-80), and the predicted amino acid sequences are shown in Table D (e.g., any one of SEQ ID NOs: 81-94).

In some embodiments, the NTRK1 nucleic acid molecule comprises sufficient nucleic acid sequence of a gene provided in Table A (e.g., any one of SEQ ID NOs: 1 or 17-41; or any of Transcript ID NOs provided in Table A) and sufficient NTRK1 nucleic acid sequence such that the encoded NTRK1 fusion polypeptide has a kinase activity, e.g., has an elevated activity, e.g., an NTRK1 kinase activity, e.g., a TRKA kinase activity, as compared with wildtype NTRK1, e.g., in a cell of a cancer referred to herein. In certain embodiments, the NTRK1 fusion comprises at least one encoded exon (or a fragment thereof) shown in the "Last exon of 5' transcript" column of Table C and at least one encoded exon (or a fragment thereof) shown in the "First exon of 3' transcript" column of Table C. In certain embodiments, the NTRK1 fusion comprises the rearrangement shown in Table E. In certain embodiments, the NTRK1 fusion comprises the exons shown in "Rearrangement" column of Table E.

In some embodiments, the nucleic acid molecule includes a nucleotide sequence that includes a breakpoint. For example, the nucleic acid molecule includes a nucleotide sequence that includes the fusion junction between a gene of Table A and the NTRK1 gene, e.g., Breakpoint 1 and/or Breakpoint 2 of Table E.

In one embodiment, the nucleic acid molecule is complementary to at least a portion of a nucleotide sequence disclosed herein, e.g., is capable of hybridizing under a stringency condition described herein to one or more of any one of SEQ ID NO: 3, 186, or 187 or a nucleotide sequence of Tables A or C (e.g., any one of SEQ ID NOs: 1 or 17-41 or 5 or 67-80) or a fragment thereof of any of the foregoing. In yet other embodiments, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to one or more of any one of SEQ ID NO: 3, 186, or 187 or a nucleotide sequence of Tables A or C (e.g., any one of SEQ ID NOs: 1 or 17-41 or 5 or 67-80) or a fragment thereof of any of the foregoing.

In another embodiment, the NTRK1 fusion nucleic acid comprises any of at least 6, at least 12, at least 15, at least 20, at least 25, at least 50, at least 75, at least 100, or more nucleotides from one or more exons of a nucleotide sequence provided in Table A (e.g., any one of SEQ ID NOs: 1 or 17-41; or any Transcript ID provided in Table A, and any of at least 6, at least 12, at least 15, at least 20, at least 25, at least 50, at least 75, at least 100, or more nucleotides from one or more exons NTRK1 (e.g., of the NTRK1 sequence shown in FIG. 4 (SEQ ID NO: 3), FIG. 36A (SEQ ID NO: 186), or FIG. 36B (SEQ ID NO: 187)).

In other embodiments, the nucleic acid molecule includes a nucleotide sequence encoding an NTRK1 fusion polypeptide that includes a fragment of a gene of Table A and a fragment of an NTRK1 gene. In one embodiment, the nucleotide sequence encodes an NTRK1 fusion polypeptide that includes e.g., an NTRK1 tyrosine kinase domain or a functional fragment thereof, e.g., a TRKA kinase domain. In yet other embodiments, the nucleic acid molecule includes a nucleotide sequence encoding the amino acid sequence (e.g., a fragment of the amino acid sequence) provided in Table B (e.g., any one of SEQ ID NOs: 42-66) and a nucleotide sequence encoding the amino acid sequence (e.g., a fragment of the amino acid sequence) shown in FIG. 5 (e.g., SEQ ID NO: 4), FIG. 36C (SEQ ID NO: 188), or FIG. 36D (SEQ ID NO: 189), or a fragment of thereof, or a sequence substantially identical thereto. In yet other embodiments, the nucleic acid includes a nucleotide sequence encoding an amino acid sequence provided in Table D (e.g., any one of SEQ ID NOs: 81-94), or a fragment thereof (or a sequence substantially identical thereto). In some embodiments, the encoded NTRK1 fusion polypeptide includes an NTRK1 tyrosine kinase domain, e.g., a TRKA kinase domain, e.g., one or more of exons 13-17 or 14-17 of any one of SEQ ID NO: 3, 186-189, or a functional fragment thereof.

In a related aspect, the disclosure features nucleic acid constructs that include the NTRK1 fusion nucleic acid molecules described herein. In certain embodiments, the nucleic acid molecules are operatively linked to a native or a heterologous regulatory sequence. Also included are vectors and host cells that include the NTRK1 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the disclosure features nucleic acid molecules that reduce or inhibit the expression of a nucleic acid molecule that encodes an NTRK1 fusion molecule described herein. Examples of such nucleic acid molecules include, for example, antisense molecules, ribozymes, RNAi, or triple helix molecules that hybridize to a nucleic acid encoding an NTRK1 fusion polypeptide, or a transcription regulatory region of an NTRK1 fusion nucleic acid molecule, and block or reduce mRNA expression of an NTRK1 fusion nucleic acid molecule.

Detection of NTRK1 Fusion Nucleic Acid Molecules

The disclosure also features a nucleic acid molecule (e.g., nucleic acid fragment, suitable as a probe, primer, bait, or a library member, that includes, flanks, or hybridizes to) which is useful for identifying, or is otherwise based on, an NTRK1 fusion described herein. In certain embodiments, the probe, primer bait, or library member is an oligonucleotide that allows capture, detection, or isolation of an NTRK1 fusion nucleic acid molecule described herein. The oligonucleotide can comprise a nucleotide sequence substantially complementary to a fragment of the NTRK1 fusion nucleic acid molecules described herein. The sequence identity between the nucleic acid fragment, e.g., the oligonucleotide, and the target NTRK1 sequence need not be exact, so long as the sequences are sufficiently complementary to allow the capture, detection or isolation of the target sequence. In one embodiment, the nucleic acid fragment is a probe or primer that includes between about 5 and 25, e.g., between 10 and 20, or 10 and 15 nucleotides. In other embodiments, the nucleic acid fragment is a bait that includes between about 100 nucleotides to about 300 nucleotides, between about 130 nucleotides to about 230 nucleotides, or between about 150 nucleotides to about 200 nucleotides.

In one embodiment, the nucleic acid fragment can be used to identify or capture, e.g., by hybridization, an NTRK1 fusion. For example, the nucleic acid fragment can be a probe, a primer, or a bait, for use in identifying or capturing, e.g., by hybridization, an NTRK1 fusion molecule described herein. In one embodiment, the nucleic acid fragment can be useful for identifying or capturing a breakpoint associated with an NTRK1 fusion nucleic acid molecule described herein, e.g., a nucleotide sequence comprise Breakpoint 1 and/or Breakpoint 2 provided in Table E, or a rearrangement provided in Table E.

In one embodiment, the nucleic acid fragment hybridizes to a nucleotide sequence within a Breakpoint 1 and/or Breakpoint 2 provided in Table E or a chromosomal rearrangement provided in Table E. For example, the nucleic acid fragment can hybridize to a nucleotide sequence that includes the fusion junction between the a gene provided in Table A and the NTRK1 gene, e.g., a nucleotide sequence that includes a portion of a nucleotide sequence of a gene in Table A (e.g., any one of SEQ ID NOs: 1 or 17-41; or any Transcript ID provided in Table A, and a portion of an NTRK1 gene.

In another embodiment, the nucleic acid fragment hybridizes to a nucleotide sequence that comprises any of at least 6, at least 12, at least 15, at least 20, at least 25, at least 50, at least 75, at least 100, at least 150, or more nucleotides from an exon provided in the "Last exon of 5' transcript"

column of Table C and any of at least 6, at least 12, at least 15, at least 20, at least 25, at least 50, at least 75, at least 100, at least 150, or more nucleotides from an exon provided in the "First exon of 3' transcript" column of Table C.

The probes or primers described herein can be used, for example, for FISH detection or PCR amplification. In one exemplary embodiment where detection is based on PCR, amplification of an NTRK1 fusion junction provided herein (e.g., a Breakpoint 1 and/or Breakpoint 1 provided in Table C or a rearrangement provided in Table C) can be performed using a primer or a primer pair, e.g., for amplifying a sequence flanking the fusion junctions described herein, e.g., the junction of a chromosomal rearrangement described herein, e.g., a Breakpoint 1 and/or Breakpoint 1 provided in Table C or a rearrangement provided in Table C.

In one embodiment, a pair of isolated oligonucleotide primers can amplify a region containing or adjacent to a position in the NTRK1 fusion. For example, forward primers can be designed to hybridize to a nucleotide sequence within the genomic sequence or mRNA sequence of a gene of Table A (e.g., a nucleotide sequence within an exon of a sequence provided in Table A, e.g., any one of SEQ ID NOs: 1 or 17-41), and the reverse primers can be designed to hybridize to a nucleotide sequence of NTRK1 (e.g., a nucleotide sequence within an exon of NTRK1, e.g., of any one of SEQ ID NO: 3, 186, or 187).

In another embodiment, the nucleic acid fragments can be used to identify, e.g., by hybridization, an NTRK1 fusion molecule. In one embodiment, the nucleic acid fragment hybridizes to a nucleotide sequence that includes a fusion junction between a gene of Table A and the NTRK1 gene.

In certain embodiments, the nucleic acid fragments are used in a FISH assay. In one embodiment, the FISH assay is a break-apart FISH assay. In one embodiment, at least two nucleic acid fragments (e.g., probes) hybridize to (e.g., are complementary to) at least two preselected nucleotide sequences of the NTRK1 fusion molecule, such that a change in (e.g., the presence or absence of) a signal associated with the nucleic acid fragments, e.g., a fluorescent signal, is indicative of the presence or absence of the NTRK1 fusion molecule or an intact NTRK1 or a gene of Table A. Typically, the nucleic acid fragments are associated with a label or signal, e.g., a covalently or non-covalently associated signal or label chosen from, e.g., a radiolabel, a fluorescent label, a bioluminescent label, a chemiluminescent label, an enzyme label, a binding pair label, or an affinity tag.

In some exemplary embodiments, at least one first nucleic acid fragment (e.g., probe) hybridizes to a gene of Table A (e.g., a nucleotide sequence within an exon of a sequence provided in Table A, e.g., any one of SEQ ID NOs: 1 or 17-41), and at least one second nucleic acid fragment (e.g., probe) hybridizes to a nucleotide sequence of NTRK1 (e.g., a nucleotide sequence within an exon of NTRK1 of any one of SEQ ID NO: 3, 186, or 187). The first and second fragments can be associated with a detectable label or signal, e.g., a fluorescent signal, such that a different signal is detected when the first and second nucleic acid fragments are in close proximity when an NTRK1 fusion nucleotide sequence is present, compared to an NTRK1 nucleotide sequence or a nucleotide sequence of a gene of Table A (e.g., an intact, full length NTRK1 nucleotide sequence or an intact, full length nucleotide sequence of a gene in Table A).

In other embodiments, the nucleic acid fragment includes a bait that comprises a nucleotide sequence that hybridizes to an NTRK1 fusion nucleic acid molecule described herein, and thereby allows the capture or isolation of said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising an NTRK1 nucleic acid molecule described herein. In one embodiment, the library member includes a rearrangement that results in an NTRK1 fusion molecule described herein.

The nucleic acid fragment can be detectably labeled with, e.g., a radiolabel, a fluorescent label, a bioluminescent label, a chemiluminescent label, an enzyme label, a binding pair label, or can include an affinity tag, a tag, or identifier (e.g., an adaptor, barcode, or other sequence identifier).

NTRK1 Fusion Polypeptides

In another embodiment, the NTRK1 fusion polypeptide comprises an amino acid sequence (e.g., a fragment of the amino acid sequence) provided in Table B (e.g., any one of SEQ ID NOs: 42-66) and an amino acid sequence (e.g., a fragment of the amino acid sequence) shown in FIG. 5 (SEQ ID NO: 4), FIG. 36C (SEQ ID NO: 188), or FIG. 36D (SEQ ID NO: 189). In one embodiment, the NTRK1 fusion polypeptide comprises an amino acid sequence substantially identical to an amino acid sequence (e.g., a fragment of the amino acid sequence) provided in Table B (e.g., any one of SEQ ID NOs: 42-66) and the amino acid sequence (e.g., a fragment of the amino acid sequence) shown in FIG. 5 (SEQ ID NO: 4), FIG. 36C (SEQ ID NO: 188), or FIG. 36D (SEQ ID NO: 189), or a fragment thereof. In one embodiment, the NTRK1 fusion polypeptide comprises an amino acid sequence at least 70%, 75%, 80%, 85%, 90%, 91%, 92%, 93%, 94%, 95%, 96%, 97%, 98%, 99%, or 99.5% identical to an amino acid sequence (e.g., a fragment of the amino acid sequence) provided in Table B (e.g., any one of SEQ ID NOs: 42-66) and the amino acid sequence (e.g., a fragment of the amino acid sequence) shown in FIG. 5 (SEQ ID NO: 4), FIG. 36C (SEQ ID NO: 188), or FIG. 36D (SEQ ID NO: 189).

In one embodiment, the NTRK1 fusion polypeptide comprises a sequence containing any of at least about 10, at least about 20, at least about 50, at least about 100, at least about 500, at least about 600, at least about 700, at least about 800, at least about 900, at least about 1000, or more amino acids of an amino acid sequence provided in Table B (e.g., any one of SEQ ID NOs: 42-66) and of the amino acid sequence provided in FIG. 5 (SEQ ID NO: 4), FIG. 36C (SEQ ID NO: 188), or FIG. 36D (SEQ ID NO: 189), in combination. In one embodiment, the NTRK1 fusion polypeptide comprises an amino acid sequence containing any of at least about 5, at least about 10, at least about 20, at least about 50, at least about 100, at least about 500, or more amino acids (e.g., contiguous amino acids) of an amino acid sequence provided in Table B (e.g., any one of SEQ ID NOs: 42-66) and any of at least about 5, at least about 10, at least about 20, at least about 50, at least about 100, at least about 500, or more amino acids (e.g., contiguous amino acids) of the amino acid sequence shown in FIG. 5 (SEQ ID NO: 4), FIG. 36C (SEQ ID NO: 188), or FIG. 36D (SEQ ID NO: 189).

In one embodiment, the NTRK1 fusion polypeptide includes an NTRK1 receptor tyrosine kinase domain (e.g., a TRKA kinase domain) or a functional fragment thereof. In an embodiment, the NTRK1 fusion polypeptide comprises sufficient NTRK1 sequence and sufficient sequence of a polypeptide comprising an amino acid sequence provided in Table B (e.g., any one of SEQ ID NOs: 42-66) such that it has a kinase activity, e.g., has an elevated activity, e.g., an NTRK1 kinase activity, e.g., a TRKA kinase activity, as compared with wildtype NTRK1, e.g., in a cell of a cancer described herein (e.g., a cancer provided in Table E).

In yet other embodiments, the NTRK1 fusion polypeptide comprises an amino acid sequence provided in Table D (e.g., any one of SEQ ID NOs: 81-94), or an amino acid sequence substantially identical thereto (e.g., at least 70%, 75%, 80%, 85%, 90%, 91%, 92%, 93%, 94%, 95%, 96%, 97%, 98%, 99%, or 99.5% identical to the amino acid sequence, or a fragment of the amino acid sequence).

In another aspect, the disclosure provides an NTRK1 fusion polypeptide (e.g., a purified NTRK1 fusion polypeptide), a biologically active or antigenic fragment thereof, as well as reagents (e.g., antibody molecules that bind to an NTRK1 fusion polypeptide), methods for modulating an NTRK1 polypeptide activity, and detection of an NTRK1 polypeptide.

In one embodiment, the NTRK1 fusion polypeptide has at least one biological activity, e.g., an NTRK1 kinase activity (e.g., a TRKA kinase activity). In one embodiment, at least one biological activity of the NTRK1 fusion polypeptide is reduced or inhibited by an anti-cancer drug, e.g., a kinase inhibitor (e.g., a multikinase inhibitor, an NTRK-specific kinase inhibitor, or an NTRK1-specific inhibitor). Exemplary multikinase inhibitors include, e.g., KRC-108, crizotinib, and K252a. In one embodiment, at least one biological activity of the NTRK1 fusion polypeptide is reduced or inhibited by an NTRK kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928. In certain embodiments, the NTRK kinase inhibitor is larotrectinib.

In yet other embodiments, the NTRK1 fusion polypeptide is encoded by a nucleic acid molecule described herein. In one embodiment, the NTRK1 fusion polypeptide is encoded by a nucleic acid comprising an in-frame fusion of an exon provided in the "Last exon of 5' transcript" column of Table C with an exon provided in the "First exon of 3' transcript" column of Table C. In another embodiment, the NTRK1 fusion polypeptide comprises an amino acid sequence encoded by a nucleotide sequence comprising a fusion junction between a transcript provided in Table A (e.g., any one of SEQ ID NOs: 1 or 17-41, or any Transcript ID provided in Table A, and the NTRK1 transcript.

In certain embodiments, the NTRK1 fusion polypeptide comprises at least one encoded exon from a gene provided in Table A (e.g., any one of SEQ ID NOs: 1 or 17-41; or any Transcript ID provided in Table A) and at least one exon of NTRK1. In certain embodiments, the NTRK1 fusion polypeptide is encoded by a nucleic acid molecule comprising Breakpoint 1 and/or Breakpoint 2 provided in Table E. In certain embodiments, the NTRK1 fusion polypeptide is encoded by a nucleic acid molecule comprising a rearrangement provided in Table E In certain embodiments, the NTRK1 fusion comprises the amino acid sequence corresponding to at least one exon or a fragment thereof from a gene provided in Table A (e.g., any one of SEQ ID NOs: 1 or 17-41; or any Transcript ID provided in Table A), and the amino acid sequence corresponding to at least one exon or a fragment thereof from NTRK1 (e.g., as shown in FIG. 5 (SEQ ID NO: 4), FIG. 36C (SEQ ID NO: 188), or FIG. 36D (SEQ ID NO: 189)). In one embodiment, the NTRK1 fusion comprises any of at least 5, at least 10, at least 15, at least 20, or more amino acids from an exon of a gene of Table B (e.g., any one of SEQ ID NOs: 42-66), and any of at least 5, at least 10, at least 15, at least 20, or more amino acids from an exon of NTRK1 (e.g., from the amino acid sequence of NTRK1, e.g., of the NTRK1 sequence shown in FIG. 5 (SEQ ID NO: 4), FIG. 36C (SEQ ID NO: 188), or FIG. 36D (SEQ ID NO: 189)).

In one embodiment, the NTRK1 fusion polypeptide includes an NTRK1 tyrosine kinase domain (e.g., a TRKA kinase domain) or a functional fragment thereof. In a related aspect, the disclosure provides NTRK1 fusion polypeptides or fragments operatively linked to heterologous polypeptides to form fusion proteins.

In another embodiment, the NTRK1 fusion polypeptide or fragment is a peptide, e.g., an immunogenic peptide or protein that contains a fusion junction described herein. Such immunogenic peptides or proteins can be used to raise antibodies specific to a fusion protein. In other embodiments, such immunogenic peptides or proteins can be used for vaccine preparation. The vaccine preparation can include other components, e.g., an adjuvant.

In another aspect, the disclosure features antibody molecules that bind to an NTRK1 fusion polypeptide or fragment described herein. In some embodiments, the antibody can distinguish wildtype NTRK1 or a wild type protein provided in Table B (e.g., a wild type protein comprising the amino acid sequence of any one of SEQ ID NOs: 42-66) from an NTRK1 fusion polypeptide described herein.

NTRK2 Fusions

NTRK2 encodes the receptor tyrosine kinase TRKB, which regulates cell proliferation, differentiation, and survival of neurons by activating several downstream pathways that also play a role in tumorigenesis (e.g., GRB2-RAS-MAPK and RAS-PI3K-AKT1). NTRK2 fusions that include an N-terminal oligomerization-promoting partner gene linked to the kinase domain of TRKB have been characterized as activating, exhibiting constitutive kinase activity and tyrosine phosphorylation. The frequency of NTRK2 fusions is relatively low in common solid tumors and hematological malignancies (<5%) but is much higher in several rare solid tumors (>80%), such as infantile fibrosarcoma and cellular and mixed congenital mesoblastic nephroma (Penault-Llorca et al., 2019; 31072837).

Provided herein are NTRK2 gene fusion molecules that comprise all or part of a gene of Table F and all or part of NTRK2. NTRK2 gene fusion molecules described herein include any fusion molecule (e.g., gene, gene product (e.g., cDNA, mRNA, or polypeptide), and variant thereof) that includes a fragment of a gene of Table F or gene product of a gene of Table F and a fragment of an NTRK2 gene or gene product described herein, including, e.g., an NTRK2 fusion molecule of Tables H, I, and J. As shown in Table J, expression of NTRK2 fusion molecules described herein has been detected in cancer tissues, thus suggesting an association With cancer, e.g., a cancer of Table J.

TABLE F

Nucleotide Sequences of NTRK2 fusion partners.

| Gene | SEQ ID NO | Locus ID |
|---|---|---|
| PPP6R3 | 95 | NM_018312 |
| PPP6R3 | 96 | NM_018312 |
| FOXB2 | 97 | NM_001013735 |
| NOD1 | 98 | NM_006092 |
| NOD1 | 99 | NM_006092 |
| DENND1A | 100 | NM_020946 |
| DENND1A | 101 | NM_020946 |
| PRRX1 | 102 | NM_022716 |
| FAM117B | 103 | NM_173511 |
| PAIP1 | 104 | NM_006451 |
| CTDSP2 | 105 | NM_005730 |
| PCSK5 | 106 | NM_001190482 |
| THADA | 107 | NM_022065 |

TABLE G

Amino Acid Sequences of NTRK2 fusion partners.

| Gene | SEQ ID NO |
|---|---|
| PPP6R3 | 108 |
| FOXB2 | 109 |
| NOD1 | 110 |
| DENND1A | 111 |
| PRRX1 | 112 |
| FAM117B | 113 |
| PAIP1 | 114 |
| CTDSP2 | 115 |
| PCSK5 | 116 |
| THADA | 117 |

TABLE H

Nucleotide Sequences of NTRK2 fusions.

| Fusion | 5' Transcript ID | Last exon of 5' transcript | 3' Transcript ID | First exon of 3' transcript | SEQ ID NO |
|---|---|---|---|---|---|
| NOD1-NTRK2 | NM_006092 | 9 | NM_006180 | 6 | 118 |
| PRRX1-NTRK2 | NM_022716 | 3 | NM_006180 | 5 | 119 |
| FAM117B-NTRK2 | NM_173511 | 1 | NM_006180 | 13 | 120 |
| PAIP1-NTRK2 | NM_006451 | 9 | NM_006180 | 11 | 121 |
| CTDSP2-NTRK2 | NM_005730 | 1 | NM_006180 | 14 | 122 |
| PCSK5-NTRK2 | NM_001190482 | 24 | NM_006180 | 11 | 123 |

TABLE I

Amino Acid Sequences of NTRK2 fusions.

| Fusion | SEQ ID NO |
|---|---|
| NOD1-NTRK2 | 124 |
| PRRX1-NTRK2 | 125 |
| FAM117B-NTRK2 | 126 |
| PAIP1-NTRK2 | 127 |
| CTDSP2-NTRK2 | 128 |
| PCSK5-NTRK2 | 129 |

TABLE J

NTRK2 fusion breakpoints.

| Fusion (5'-3') | Breakpoint 1 | Breakpoint 2 | Cancer Type | Rearrangement |
|---|---|---|---|---|
| PPP6R3-NTRK2 | chr11: 68341673 | chr9: 87285944 | Duodenum adenocarcinoma | Chr11: Chr9 translocation; PPP6R3(exons 1-13 NM_018312)-NTRK2(exons 3-19 NM_006180); breakpoints: NTRK2 intron 2, PPP6R3 exon 13; Reciprocal: Yes; FIGS. 21-22 |

TABLE J-continued

NTRK2 fusion breakpoints.

| Fusion (5'-3') | Breakpoint 1 | Breakpoint 2 | Cancer Type | Rearrangement |
|---|---|---|---|---|
| FOXB2-NTRK2 | Chr9: 87358998-87359350 | Chr9: 79635277-79635505 | Breast carcinoma (NOS) | Deletion; FOXB2 (last exon of 5' transcript [NM_001013735]: exon 1)-NTRK2 (First exon of 3' transcript [NM_006180]: exon 11). |
| NOD1-NTRK2 | Chr9: 87322630-87323000 | Chr7: 30485058-30485317 | Bladder urothelial (transitional cell) carcinoma | Chr7: 9 translocation; NOD1 (last exon of 5' transcript [NM_006092]: exon 9)-NTRK2 (first exon of 3' transcript [NM_006180]: exon 6); FIGS. 30B-30C |
| DENND1A-NTRK2 | chr9: 126418582 | chr9: 87476025 | Pancreas ductal adenocarcinoma | Inversion; DENND1A(exons 1-8 NM_020946)-NTRK2(exons 14-19 NM_006180); breakpoints: DENND1A intron 8, NTRK2 intron 13. |
| PRRX1-NTRK2 | chr1: 170695373 | chr9: 87325546 | Soft tissue sarcoma undifferentiated | Chr1: Chr9 translocation; PRRX1(exons 1-3 NM_022716)-NTRK2(exons 5-19 NM_006180). |
| FAM117B-NTRK2 | chr2: 203540407 | chr9: 87475796 | Head and neck squamous cell carcinoma (HNSCC) | Chr2: Chr9 translocation; FAM117B(exons 1-1 NM_173511)-NTRK2(exons 13-19 NM_006180); breakpoints: FAM117B intron 1, NTRK2 intron 12. |
| PAIP1-NTRK2 | chr5: 43531836 | chr9: 87358662 | Brain glioblastoma (GBM) | Chr5: Chr9 translocation; PAIP1(exons 1-9 NM_006451)-NTRK2(exons 11-19 NM_006180); breakpoints: PAIP1 intron 9, NTRK2 intron 10; Reciprocal: Yes. |
| CTDSP2-NTRK2 | chr12: 58240155 | chr9: 87482158 | Soft tissue liposarcoma | Ch12: Chr9 translocation; CTDSP2(exons 1-1 NM_005730)-NTRK2(exons 14-19 NM_006180); Reciprocal: no. |
| PCSK5-NTRK2 | chr9: 78863564 | chr9: 87359395 | Lung adenocarcinoma | Deletion; PCSK5(exons 1-24 NM_001190482)-NTRK2(exons 11-19 NM_006180); breakpoints: PCSK5 intron 24, NTRK2 intron 10. |
| THADA-NTRK2 | chr2: 43472620 | chr9: 87342768 | Ovary serous carcinoma | Chr2: Chr9 translocation; THADA(exons 1-36 NM_022065)-NTRK2(exons 9-19 NM_006180); breakpoints: THADA intron 36, NTRK2 exon 9; FIGS. 34A-34B |

In one embodiment, the NTRK2 fusion molecule includes an in-frame fusion of an exon of a gene of Table F, e.g., one more exons of a gene of Table F (e.g., as described in Tables H or J) or a fragment thereof, and one or more exons of NTRK2, e.g., one or more exons of an NTRK2 gene, e.g., an NTRK2 gene comprising the nucleotide sequence of SEQ ID NO: 190 (FIG. 37A) or SEQ ID NO: 194 (FIG. 37C) or a fragment thereof, e.g., as described in Tables H or J. In some embodiments, the NTRK2 fusion molecule includes all or part of at least one exon of a nucleotide sequence of any one of SEQ ID NOs: 95-107, or of a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In some embodiments, the NTRK2 fusion molecule includes all or part of at least one exon of a Transcript ID shown in Tables F, H, or J or of a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto), or all or part of at least one exon of any Transcript ID provided in Table F, or of a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto).

In some embodiments, the NTRK2 fusion molecule comprises an in-frame fusion of an exon provided in the "Last exon of 5' transcript" column of Table H with an exon provided in the "First exon of 3' transcript" column of Table H.

In another embodiment, the fusion molecule includes the nucleotide sequence of any one of SEQ ID NOs: 118-123, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion molecule encodes the amino acid sequence of any one of SEQ ID NOs: 124-129, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In some embodiments, the NTRK2 fusion molecule can include an in-frame fusion within an intron of a gene of Table F (e.g., as described in Tables H or J) or a fragment thereof, with an intron of NTRK2 (e.g., as described in Tables H or J) or a fragment thereof. In some embodiments, the NTRK2 fusion comprises a Breakpoint 1 and/or a Breakpoint 2 of Table J. In some embodiments, the NTRK2 fusion comprises a rearrangement of Table J. In some embodiments, the NTRK2 fusion is a rearrangement described in Table J.

The term "fusion" or "fusion molecule" can refer to a fusion polypeptide or a fusion nucleic acid/fusion nucleic acid molecule, depending on the context. It may include a full-length sequence of a fusion or a fragment thereof, e.g., a fragment comprising a fusion junction (e.g., a fragment including a portion of a gene of Table F and a portion of NTRK2, e.g., a portion of an NTRK2 fusion molecule described herein, e.g., as described in Table H). In one embodiment, an NTRK2 fusion polypeptide includes a fragment of the amino acid sequence of SEQ ID NO: 191 (FIG. 37B) or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto) and a fragment of the amino acid sequence of any one of SEQ ID NOs: 108-117, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the NTRK2 fusion polypeptide includes the amino acid sequence of SEQ ID NO: 124-129, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In another embodiment, the NTRK2 fusion nucleic acid molecule includes a fragment of a nucleotide sequence of Table F and a fragment of the nucleotide sequence of SEQ ID NO: 190 or SEQ ID NO: 194, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes the nucleotide sequence of any one of SEQ ID NOs: 118-123 or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion nucleic acid molecule includes a nucleotide sequence encoding the amino acid sequence of any one of SEQ ID NOs: 124-129, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the NTRK2 fusion polypeptide comprises sufficient sequence of an amino acid sequence of Table G (e.g., any one of SEQ ID NOs: 108-117) and sufficient NTRK2 sequence (e.g., sufficient sequence of the amino acid sequence of SEQ ID NO: 191) such that the fusion (e.g., a fusion of Table I, e.g., comprising the sequence of any one of SEQ ID NOs: 124-129) has a kinase activity, e.g., has an elevated (e.g., constitutive) activity, e.g., an NTRK2 tyrosine kinase activity, e.g., a TRKB kinase activity, as compared with wildtype NTRK2, e.g., in a cell of a cancer described to herein (e.g., a cancer described herein or provided in Table J).

In some embodiments, the NTRK2 fusion comprises a fusion shown in Table H, wherein the genes in the Fusion are provided in the 5' to 3' direction. In some embodiments, the NTRK2 fusion comprises any of at least 1, at least 5, at least 10, at least 15, at least 20, at least 25, at least 30, at least 40, at least 50, or more amino acids of an exon shown in the "Last exon of 5' transcript" column of Table H, and any of at least 1, at least 5, at least 10, at least 15, at least 20, at least 25, at least 30, at least 40, at least 50, or more amino acids of an exon shown in the "First exon of 3' transcript" column of Table H.

In some embodiments, the NTRK2 fusion comprises a fusion shown in Table H, wherein the genes in the Fusion are provided in the 5' to 3' direction. In some embodiments, the NTRK2 fusion comprises any of at least 3, at least 6, at least 12, at least 15, at least 20, at least 25, at least 50, at least 75, at least 100, or more nucleotides of an exon shown in the "Last exon of 5' transcript" column of Table H, and any of at least 3, at least 6, at least 12, at least 15, at least 20, at least 25, at least 50, at least 75, at least 100, or more nucleotides of an exon shown in the "First exon of 3' transcript" column of Table H.

In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of PPP6R3 (e.g., having the nucleotide sequence of SEQ ID NO: 95 or of Transcript ID NM_018312, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of PPP6R3 (e.g., having the nucleotide sequence of SEQ ID NO: 96 or of Transcript ID NM_018312, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of FOXB2 (e.g., having the nucleotide sequence of SEQ ID NO: 97 or of Transcript ID NM_001013735, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of NOD1 (e.g., having the nucleotide sequence of SEQ ID NO: 98 or of Transcript ID NM_006092, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of NOD1 (e.g., having the nucleotide sequence of SEQ ID NO: 99 or of Transcript ID NM_006092, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of DENND1A (e.g., having the nucleotide sequence of SEQ ID NO: 100 or of Transcript ID NM_020946, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of DENND1A (e.g., having the nucleotide sequence of SEQ ID NO: 101 or of Transcript ID NM_020946, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of PRRX1 (e.g., having the nucleotide sequence of SEQ ID NO: 102 or of Transcript ID NM_022716, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of FAM117B (e.g., having the nucleotide sequence of SEQ ID NO: 103 or of Transcript ID NM_173511, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of PAIP1 (e.g., having the nucleotide sequence of SEQ ID NO: 104 or of Transcript ID NM_006451, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of CTDSP2 (e.g., having the nucleotide sequence of SEQ ID NO: 105 or of Transcript ID NM_005730, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of PCSK5 (e.g., having the nucleotide sequence of SEQ ID NO: 106 or of Transcript ID NM_001190482, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of all or a part of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and all or a part of THADA (e.g., having the nucleotide sequence of SEQ ID NO: 107 or of Transcript ID NM_022065, or a nucleotide sequence at least 70%, 75%, 80%, 85%, 90%, 91%, 92%, 93%, 94% 95%, 96%, 97%, 98%, 99%, or 99.5% identical thereto).

In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of PPP6R3 (e.g., having the nucleotide sequence of SEQ ID NO: 95 or of Transcript ID NM_018312, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of PPP6R3 (e.g., having the nucleotide sequence of SEQ ID NO: 96 or of Transcript ID NM_018312, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of FOXB2 (e.g., having the nucleotide sequence of SEQ ID NO: 97 or of Transcript ID NM_001013735, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of NOD1 (e.g., having the nucleotide sequence of SEQ ID NO: 98 or of Transcript ID NM_006092, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of NOD1 (e.g., having the nucleotide sequence of SEQ ID NO: 99 or of Transcript ID NM_006092, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of DENND1A (e.g., having the nucleotide sequence of SEQ ID NO: 100 or of Transcript ID NM_020946, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of DENND1A (e.g., having the nucleotide sequence of SEQ ID NO: 101 or of Transcript ID NM_020946, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of PRRX1 (e.g., having the nucleotide sequence of SEQ ID NO: 102 or of Transcript ID NM_022716, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of FAM117B (e.g., having the nucleotide sequence of SEQ ID NO: 103 or of Transcript ID NM_173511, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of PAIP1 (e.g., having the nucleotide sequence of SEQ ID NO: 104 or of Transcript ID NM_006451, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of CTDSP2 (e.g., having the nucleotide sequence of SEQ ID NO: 105 or of Transcript ID NM_005730, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of PCSK5 (e.g., having the nucleotide sequence of SEQ ID NO: 106 or of Transcript ID NM_001190482, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK2 fusion provided herein comprises a fusion of one or more exons of an NTRK2 gene (e.g., an NTRK2 gene provided herein, e.g., having a nucleotide sequence of any of SEQ ID NOs: 190 or 194, or a nucleotide sequence at least 70%, 75%, 80%, 85%, 90%, 91%, 92%, 93%, 94% 95%, 96%, 97%, 98%, 99%, or 99.5% identical thereto) and one or more exons of THADA (e.g., having the nucleotide sequence of SEQ ID NO: 107 or of Transcript ID NM_022065, or a nucleotide sequence at least 70%, 75%, 80%, 85%, 90%, 91%, 92%, 93%, 94% 95%, 96%, 97%, 98%, 99%, or 99.5% identical thereto).

In some embodiments, a NOD1-NTRK2 fusion provided herein comprises the nucleotide sequence of SEQ ID NO: 118, or a nucleotide sequence at least 70%, 75%, 80%, 85%, 90%, 91%, 92%, 93%, 94% 95%, 96%, 97%, 98%, 99%, or 99.5% identical thereto. In some embodiments, a PRRX1-NTRK2 fusion provided herein comprises the nucleotide sequence of SEQ ID NO: 119, or a nucleotide sequence at least 70%, 75%, 80%, 85%, 90%, 91%, 92%, 93%, 94% 95%, 96%, 97%, 98%, 99%, or 99.5% identical thereto. In some embodiments, a FAM117B-NTRK2 fusion provided herein comprises the nucleotide sequence of SEQ ID NO: 120, or a nucleotide sequence at least 70%, 75%, 80%, 85%, 90%, 91%, 92%, 93%, 94% 95%, 96%, 97%, 98%, 99%, or 99.5% identical thereto. In some embodiments, a PAIP1-NTRK2 fusion provided herein comprises the nucleotide sequence of SEQ ID NO: 121, or a nucleotide sequence at least 70%, 75%, 80%, 85%, 90%, 91%, 92%, 93%, 94% 95%, 96%, 97%, 98%, 99%, or 99.5% identical thereto. In some embodiments, a CTDSP2-NTRK2 fusion provided herein comprises the nucleotide sequence of SEQ ID NO: 122, or a nucleotide sequence at least 70%, 75%, 80%, 85%, 90%, 91%, 92%, 93%, 94% 95%, 96%, 97%, 98%, 99%, or 99.5% identical thereto. In some embodiments, a PCSK5-NTRK2 fusion provided herein comprises the nucleotide sequence of SEQ ID NO: 123, or a nucleotide sequence at least 70%, 75%, 80%, 85%, 90%, 91%, 92%, 93%, 94% 95%, 96%, 97%, 98%, 99%, or 99.5% identical thereto.

In some embodiments, a NOD1-NTRK2 fusion provided herein comprises a nucleotide sequence encoding an amino acid sequence of SEQ ID NO: 124, or a nucleotide sequence at least 70%, 75%, 80%, 85%, 90%, 91%, 92%, 93%, 94% 95%, 96%, 97%, 98%, 99%, or 99.5% identical thereto. In some embodiments, a PRRX1-NTRK2 fusion provided herein comprises a nucleotide sequence encoding an amino acid sequence of SEQ ID NO: 125, or a nucleotide sequence at least 70%, 75%, 80%, 85%, 90%, 91%, 92%, 93%, 94% 95%, 96%, 97%, 98%, 99%, or 99.5% identical thereto. In some embodiments, a FAM117B-NTRK2 fusion provided herein comprises a nucleotide sequence encoding an amino acid sequence of SEQ ID NO: 126, or a nucleotide sequence at least 70%, 75%, 80%, 85%, 90%, 91%, 92%, 93%, 94% 95%, 96%, 97%, 98%, 99%, or 99.5% identical thereto. In some embodiments, a PAIP1-NTRK2 fusion provided herein comprises a nucleotide sequence encoding an amino acid sequence of SEQ ID NO: 127, or a nucleotide sequence at least 70%, 75%, 80%, 85%, 90%, 91%, 92%, 93%, 94% 95%, 96%, 97%, 98%, 99%, or 99.5% identical thereto. In some embodiments, a CTDSP2-NTRK2 fusion provided herein comprises a nucleotide sequence encoding an amino acid sequence of SEQ ID NO: 128, or a nucleotide sequence at least 70%, 75%, 80%, 85%, 90%, 91%, 92%, 93%, 94% 95%, 96%, 97%, 98%, 99%, or 99.5% identical thereto. In some embodiments, a PCSK5-NTRK2 fusion provided herein comprises a nucleotide sequence encoding an amino acid sequence of SEQ ID NO: 129, or a nucleotide sequence at least 70%, 75%, 80%, 85%, 90%, 91%, 92%, 93%, 94% 95%, 96%, 97%, 98%, 99%, or 99.5% identical thereto.

In some embodiments, a PPP6R3-NTRK2 fusion provided herein comprises, in the 5' to 3' direction, a Breakpoint 1 of chr11:68341673 and a Breakpoint 2 of chr9:87285944. In some embodiments, a FOXB2-NTRK2 fusion provided herein comprises, in the 5' to 3' direction, a Breakpoint 1 of Chr9: 87358998-87359350 and a Breakpoint 2 of Chr9: 79635277-79635505. In some embodiments, a NOD1-NTRK2 fusion provided herein comprises, in the 5' to 3' direction, a Breakpoint 1 of Chr9: 87322630-87323000 and a Breakpoint 2 of Chr7:30485058-30485317. In some embodiments, a DENND1A-NTRK2 fusion provided herein comprises, in the 5' to 3' direction, a Breakpoint 1 of chr9:126418582 and a Breakpoint 2 of chr9:87476025. In some embodiments, a PRRX1-NTRK2 fusion provided herein comprises, in the 5' to 3' direction, a Breakpoint 1 of chr1:170695373 and a Breakpoint 2 of chr9:87325546. In some embodiments, a FAM117B-NTRK2 fusion provided herein comprises, in the 5' to 3' direction, a Breakpoint 1 of chr2:203540407 and a Breakpoint 2 of chr9:87475796. In some embodiments, a PAIP1-NTRK2 fusion provided herein comprises, in the 5' to 3' direction, a Breakpoint 1 of chr5:43531836 and a Breakpoint 2 of chr9:87358662. In some embodiments, a CTDSP2-NTRK2 fusion provided herein comprises, in the 5' to 3' direction, a Breakpoint 1 of chr12:58240155 and a Breakpoint 2 of chr9:87482158. In some embodiments, a PCSK5-NTRK2 fusion provided herein comprises, in the 5' to 3' direction, a Breakpoint 1 of chr9:78863564 and a Breakpoint 2 of chr9:87359395. In some embodiments, a THADA-NTRK2 fusion provided herein comprises, in the 5' to 3' direction, a Breakpoint 1 of chr2:43472620 and a Breakpoint 2 of chr9:87342768.

NTRK2 Fusion Nucleic Acid Molecules

In one aspect, provided herein are nucleic acid molecules (e.g., an isolated or purified nucleic acid molecule) that comprising a fragment of a gene of Table F and a fragment of an NTRK2 gene. In one embodiment, the fusion nucleic acid molecule includes a nucleotide sequence encoding an NTRK2 fusion polypeptide provided herein (e.g., as shown in Table I) that includes an NTRK2 tyrosine kinase domain or a functional fragment thereof, e.g., a TRKB kinase domain or a functional fragment thereof. In other embodiments, the fusion nucleic acid molecule includes a nucleotide sequence encoding a fragment of a polypeptide of Table G or a fragment thereof or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding a fragment of a polypeptide of any one of SEQ ID NOs: 108-117 or a fragment thereof or a sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes a nucleotide sequence encoding a fragment of the NTRK2 polypeptide including the amino acid sequence of SEQ ID NO: 191 or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding an amino acid sequence provided in Table G (e.g., any one of SEQ ID NOs: 108-117), or a fragment thereof, and the amino acid sequence of SEQ ID NO: 191 or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding an amino acid sequence provided in Table I (e.g., any one of SEQ ID NOs: 124-129), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the NTRK2 nucleic acid molecule includes a fusion, e.g., resulting in an in-frame fusion, between an intron of a gene of Table F (e.g., as described in Tables H or J) and an intron of NTRK2 (e.g., as described in Tables H or J). In some embodiments, the NTRK2 fusion nucleic acid molecule comprises a Breakpoint 1 and/or a Breakpoint 2 provided in Table J. In some embodiments, the NTRK2 fusion nucleic acid molecule comprises a rearrangement provided in Table J.

In another embodiment, the NTRK2 fusion nucleic acid molecule comprises a nucleotide sequence (e.g., a fragment of a nucleotide sequence) shown in Table F (e.g., any one of SEQ ID NOs: 95-107) and a nucleotide sequence (e.g., a fragment of a nucleotide sequence) of SEQ ID NO: 190 or SEQ ID NO: 194, or a fragment of the fusion nucleic acid molecule. In one embodiment, the NTRK2 fusion nucleic acid molecule comprises a nucleotide sequence substantially identical to a nucleotide sequence (e.g., a fragment of a nucleotide sequence) shown in Table F (e.g., any one of SEQ ID NOs: 95-107) and a nucleotide sequence substantially identical to the nucleotide sequence (e.g., a fragment of a nucleotide sequence) of SEQ ID NO: 190 or SEQ ID NO: 194. In another embodiment, the NTRK2 fusion nucleic acid molecule comprises a nucleotide sequence (e.g., a fragment of a nucleotide sequence) shown in Table H (e.g., any one of SEQ ID NOs: 118-123), or a fragment thereof. In one embodiment, the NTRK2 fusion nucleic acid molecule comprises a nucleotide sequence substantially identical to a nucleotide sequence (e.g., a fragment of a nucleotide sequence) shown in Table H (e.g., any one of SEQ ID NOs: 118-123), or a fragment thereof.

In one embodiment, the NTRK2 fusion nucleic acid molecule comprises a nucleotide sequence at least 70%, 75%, 80%, 85%, 90%, 91%, 92%, 93%, 94%, 95%, 96%, 97%, 98%, 99%, or 99.5% identical to a nucleotide sequence (e.g., a fragment of a nucleotide sequence) provided in Table F (e.g., any one of SEQ ID NOs: 95-107) and to the nucleotide sequence (e.g., a fragment of a nucleotide sequence) of SEQ ID NO: 190 or SEQ ID NO: 194. In yet other embodiments, the NTRK2 fusion nucleic acid molecule comprises a nucleotide sequence of Table H (e.g., any one of SEQ ID NOs: 118-123), or a fragment thereof, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical to the nucleotide sequence, or a fragment of a nucleotide sequence). In one embodiment, the NTRK2 fusion nucleic acid molecule comprises a nucleotide sequence containing at least 25, 50, 100, 150, 200, 500, 1000, 1500, 2000, 2500, 3000, 4000, 5000, 6000, or more nucleotides of a nucleotide sequence shown in Table F (e.g., any one of SEQ ID NOs: 95-107) and a nucleotide sequence containing at least 25, 50, 100, 150, 200, 500, 1000, 1500, 2000, 2500, or more nucleotides of the nucleotide sequence of SEQ ID NO: 190 or SEQ ID NO: 194. In one embodiment, the NTRK2 fusion nucleic acid molecule comprises a nucleotide sequence containing at least 25, 50, 100, 150, 200, 500, 1000, 1500, 2000, 2500, 3000, 4000, 5000, 6000, or more nucleotides (e.g., contiguous nucleotides) of a nucleotide sequence shown in Table F (e.g., any one of SEQ ID NOs: 95-107) and a nucleotide sequence containing at least 25, 50, 100, 150, 200, 500, 1000, 1500, 2000, 2500, or more nucleotides of the nucleotide sequence of SEQ ID NO: 190 or SEQ ID NO: 194.

In another embodiment, the nucleic acid molecule includes a fusion, e.g., resulting in an in-frame fusion, of at least one exon of a gene (or of a Transcript ID) provided in Table F or a fragment thereof and at least one exon or a fragment thereof of NTRK2 or a fragment thereof. In yet other embodiments, the nucleic acid molecule includes a fragment of a nucleotide sequence shown in Table F (e.g., any one of SEQ ID NOs: 95-107) and a fragment of the nucleotide sequence of SEQ ID NO: 190 or SEQ ID NO: 194, or a sequence substantially identical thereto (e.g., at least 70%, 75%, 80%, 85%, 90%, 91%, 92%, 93%, 94%, 95%, 96%, 97%, 98%, 99%, or 99.5% identical thereto), or a nucleotide sequence shown in Table H (e.g., any one of SEQ ID NOs: 118-123), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the nucleic acid molecule is complementary to at least a portion of a nucleotide sequence disclosed herein, e.g., is capable of hybridizing under a stringency condition described herein to a nucleotide sequence of SEQ ID NO: 190 or SEQ ID NO: 194 and/or to a nucleotide sequence provided in Table F or Table H (e.g., any one of SEQ ID NOs: 95-107 or 118-123), or a fragment of any of the aforesaid nucleic acid sequences. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence of SEQ ID NO: 190 or SEQ ID NO: 194 and/or to a nucleotide sequence provided in Table F or Table H (e.g., any one of SEQ ID NOs: 95-107 or 118-123), or a fragment thereof. The nucleotide sequence of a cDNA encoding exemplary NTRK2 fusions are shown in Table H (e.g., any one of SEQ ID NOs: 118-123), and the predicted amino acid sequences are shown in Table I (e.g., any one of SEQ ID NOs: 124-129).

In some embodiments, the NTRK2 nucleic acid molecule comprises sufficient nucleic acid sequence of a gene provided in Table F (e.g., any one of SEQ ID NOs: 95-107; or any Transcript ID provided in Table F) and sufficient NTRK2 nucleic acid sequence such that the encoded NTRK2fusion polypeptide has a kinase activity, e.g., has an elevated activity, e.g., an NTRK2 kinase activity, e.g., a TRKB kinase activity, as compared with wildtype NTRK2, e.g., in a cell of a cancer referred to herein. In certain embodiments, the NTRK2 fusion comprises at least one encoded exon (or a fragment thereof) shown in the "Last exon of 5' transcript" column of Table H and at least one encoded exon (or a fragment thereof) shown in the "First exon of 3' transcript" column of Table H. In certain embodiments, the NTRK2 fusion comprises the rearrangement shown in Table J. In certain embodiments, the NTRK2 fusion comprises the exons shown in "Rearrangement" column of Table J.

In some embodiments, the nucleic acid molecule includes a nucleotide sequence that includes a breakpoint. For example, the nucleic acid molecule includes a nucleotide sequence that includes the fusion junction between a gene of Table F and the NTRK2 gene, e.g., Breakpoint 1 and/or Breakpoint 2 of Table J.

In one embodiment, the nucleic acid molecule is complementary to at least a portion of a nucleotide sequence disclosed herein, e.g., is capable of hybridizing under a stringency condition described herein to one or more of SEQ ID NO: 190 or SEQ ID NO: 194 or a nucleotide sequence of Tables F or H (e.g., any one of SEQ ID NOs: 95-107 or 118-123) or a fragment thereof of any of the foregoing. In yet other embodiments, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to one or more of SEQ ID NO: 190 or SEQ ID NO: 194 or a nucleotide sequence of Tables F or H (e.g., any one of SEQ ID NOs: 95-107 or 118-123) or a fragment thereof of any of the foregoing.

In another embodiment, the NTRK2 fusion nucleic acid comprises any of at least 6, at least 12, at least 15, at least 20, at least 25, at least 50, at least 75, at least 100, or more nucleotides from one or more exons of a nucleotide sequence provided in Table F (e.g., any one of SEQ ID NOs: 95-107; or any Transcript ID provided in Table F, and any of at least 6, at least 12, at least 15, at least 20, at least 25, at least 50, at least 75, at least 100, or more nucleotides from one or more exons NTRK2 (e.g., of the NTRK2 sequence comprising the nucleotide sequence of SEQ ID NO: 190 or SEQ ID NO: 194).

In other embodiments, the nucleic acid molecule includes a nucleotide sequence encoding an NTRK2 fusion polypeptide that includes a fragment of a gene of Table F and a fragment of an NTRK2 gene. In one embodiment, the nucleotide sequence encodes an NTRK2 fusion polypeptide that includes e.g., an NTRK2 tyrosine kinase domain or a functional fragment thereof, e.g., a TRKB kinase domain. In yet other embodiments, the nucleic acid molecule includes a nucleotide sequence encoding the amino acid sequence (e.g., a fragment of the amino acid sequence) provided in Table G (e.g., any one of SEQ ID NOs: 108-117) and a nucleotide sequence encoding the amino acid sequence (e.g., a fragment of the amino acid sequence) of SEQ ID NO: 191, or a fragment of thereof, or a sequence substantially identical thereto. In yet other embodiments, the nucleic acid includes a nucleotide sequence encoding an amino acid sequence provided in Table I (e.g., any one of SEQ ID NOs: 124-129), or a fragment thereof (or a sequence substantially identical thereto). In one embodiment, the encoded NTRK2 fusion polypeptide includes an NTRK2 tyrosine kinase domain, e.g., a TRKB kinase domain, e.g., one or more of exons 14-19 of SEQ ID NO: 190-194, or a functional fragment thereof.

In a related aspect, the disclosure features nucleic acid constructs that include the NTRK2 fusion nucleic acid molecules described herein. In certain embodiments, the nucleic acid molecules are operatively linked to a native or a heterologous regulatory sequence. Also included are vectors and host cells that include the NTRK2 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the disclosure features nucleic acid molecules that reduce or inhibit the expression of a nucleic acid molecule that encodes an NTRK2 fusion molecule described herein. Examples of such nucleic acid molecules include, for example, antisense molecules, ribozymes, RNAi, or triple helix molecules that hybridize to a nucleic acid encoding an NTRK2 fusion polypeptide, or a transcription regulatory region of an NTRK2 fusion nucleic acid molecule, and block or reduce mRNA expression of an NTRK2 fusion nucleic acid molecule.

In some embodiments, NTRK2 fusion provided herein comprises an NTRK2 sequence corresponding to transcript ID NM_006180.6 or a sequence at least 70%, 75%, 80%, 85%, 90%, 91%, 92%, 93%, 94% 95%, 96%, 97%, 98%, 99%, or 99.5% identical thereto, or a fragment thereof.

Detection of NTRK2 Fusion Nucleic Acid Molecules

The disclosure also features a nucleic acid molecule (e.g., nucleic acid fragment, suitable as a probe, primer, bait, or a library member, that includes, flanks, or hybridizes to) which is useful for identifying, or is otherwise based on, an NTRK2 fusion described herein. In certain embodiments, the probe, primer bait, or library member is an oligonucleotide that allows capture, detection, or isolation of an NTRK2 fusion nucleic acid molecule described herein. The oligonucleotide can comprise a nucleotide sequence substantially complementary to a fragment of the NTRK2 fusion nucleic acid molecules described herein. The sequence identity between the nucleic acid fragment, e.g., the oligonucleotide, and the target NTRK2 sequence need not be exact, so long as the sequences are sufficiently complementary to allow the capture, detection or isolation of the target sequence. In one embodiment, the nucleic acid fragment is a probe or primer that includes between about 5 and 25, e.g., between 10 and 20, or 10 and 15 nucleotides. In other embodiments, the nucleic acid fragment is a bait that includes between about 100 nucleotides to about 300 nucleotides, between about 130 nucleotides to about 230 nucleotides, or between about 150 nucleotides to about 200 nucleotides.

In one embodiment, the nucleic acid fragment can be used to identify or capture, e.g., by hybridization, an NTRK2 fusion. For example, the nucleic acid fragment can be a probe, a primer, or a bait, for use in identifying or capturing, e.g., by hybridization, an NTRK2 fusion molecule described herein. In one embodiment, the nucleic acid fragment can be useful for identifying or capturing a breakpoint associated with an NTRK2 fusion nucleic acid molecule described herein, e.g., a nucleotide sequence comprise Breakpoint 1 and/or Breakpoint 2 provided in Table J, or a rearrangement provided in Table J.

In one embodiment, the nucleic acid fragment hybridizes to a nucleotide sequence within a Breakpoint 1 and/or Breakpoint 2 provided in Table J or a chromosomal rearrangement provided in Table J. For example, the nucleic acid fragment can hybridize to a nucleotide sequence that includes the fusion junction between the a gene provided in Table F and the NTRK2 gene, e.g., a nucleotide sequence that includes a portion of a nucleotide sequence of a gene in Table F (e.g., any one of SEQ ID NOs: 95-107; or any Transcript IDs provided in Table F) and a portion of an NTRK2 gene.

In another embodiment, the nucleic acid fragment hybridizes to a nucleotide sequence that comprises any of at least 6, at least 12, at least 15, at least 20, at least 25, at least 50, at least 75, at least 100, at least 150, or more nucleotides from an exon provided in the "Last exon of 5' transcript" column of Table H and any of at least 6, at least 12, at least 15, at least 20, at least 25, at least 50, at least 75, at least 100, at least 150, or more nucleotides from an exon provided in the "First exon of 3' transcript" column of Table H.

The probes or primers described herein can be used, for example, for FISH detection or PCR amplification. In one exemplary embodiment where detection is based on PCR, amplification of an NTRK2 fusion junction provided herein (e.g., a Breakpoint 1 and/or Breakpoint 1 provided in Table H or a rearrangement provided in Table H) can be performed using a primer or a primer pair, e.g., for amplifying a sequence flanking the fusion junctions described herein, e.g., the junction of a chromosomal rearrangement described herein, e.g., a Breakpoint 1 and/or Breakpoint 1 provided in Table H or a rearrangement provided in Table H.

In one embodiment, a pair of isolated oligonucleotide primers can amplify a region containing or adjacent to a position in the NTRK2 fusion. For example, forward primers can be designed to hybridize to a nucleotide sequence within the genomic sequence or mRNA sequence of a gene of Table F (e.g., a nucleotide sequence within an exon of a sequence provided in Table F, e.g., any one of SEQ ID NOs: 95-107), and the reverse primers can be designed to hybridize to a nucleotide sequence of NTRK2 (e.g., a nucleotide sequence within an exon NTRK2 of SEQ ID NO: 190 or SEQ ID NO: 194).

In another embodiment, the nucleic acid fragments can be used to identify, e.g., by hybridization, an NTRK2 fusion molecule. In one embodiment, the nucleic acid fragment hybridizes to a nucleotide sequence that includes a fusion junction between a gene of Table F and the NTRK2 gene.

In certain embodiments, the nucleic acid fragments are used in a FISH assay. In one embodiment, the FISH assay is a break-apart FISH assay. In one embodiment, at least two nucleic acid fragments (e.g., probes) hybridize to (e.g., are complementary to) at least two preselected nucleotide sequences of the NTRK2 fusion molecule, such that a change in (e.g., the presence or absence of) a signal associated with the nucleic acid fragments, e.g., a fluorescent signal, is indicative of the presence or absence of the NTRK2 fusion molecule or an intact NTRK2 or a gene of Table F. Typically, the nucleic acid fragments are associated with a label or signal, e.g., a covalently or non-covalently associated signal or label chosen from, e.g., a radiolabel, a fluorescent label, a bioluminescent label, a chemiluminescent label, an enzyme label, a binding pair label, or an affinity tag.

In some exemplary embodiments, at least one first nucleic acid fragment (e.g., probe) hybridizes to a gene of Table F (e.g., a nucleotide sequence within an exon of a sequence provided in Table F, e.g., any one of SEQ ID NOs: 95-107), and at least one second nucleic acid fragment (e.g., probe) hybridizes to a nucleotide sequence of NTRK2 (e.g., a nucleotide sequence within an exon of NTRK2 of SEQ ID NO: 190 or SEQ ID NO: 194). The first and second fragments can be associated with a detectable label or signal, e.g., a fluorescent signal, such that a different signal is detected when the first and second nucleic acid fragments are in close proximity when an NTRK2 fusion nucleotide sequence is present, compared to an NTRK2 nucleotide sequence or a nucleotide sequence of a gene of Table F (e.g., an intact, full length NTRK2 nucleotide sequence or an intact, full length nucleotide sequence of a gene in Table F).

In other embodiments, the nucleic acid fragment includes a bait that comprises a nucleotide sequence that hybridizes to an NTRK2 fusion nucleic acid molecule described herein, and thereby allows the capture or isolation of said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising an NTRK2 nucleic acid molecule described herein. In one embodiment, the library member includes a rearrangement that results in an NTRK2 fusion molecule described herein.

The nucleic acid fragment can be detectably labeled with, e.g., a radiolabel, a fluorescent label, a bioluminescent label, a chemiluminescent label, an enzyme label, a binding pair label, or can include an affinity tag, a tag, or identifier (e.g., an adaptor, barcode, or other sequence identifier).

NTRK2 Fusion Polypeptides

In another embodiment, the NTRK2 fusion polypeptide comprises an amino acid sequence (e.g., a fragment of the amino acid sequence) provided in Table G (e.g., any one of SEQ ID NOs: 108-117) and an amino acid sequence (e.g., a fragment of the amino acid sequence) of SEQ ID NO: 191. In one embodiment, the NTRK2 fusion polypeptide comprises an amino acid sequence substantially identical to an amino acid sequence (e.g., a fragment of the amino acid sequence) provided in Table G (e.g., any one of SEQ ID NOs: 108-117) and the amino acid sequence (e.g., a fragment of the amino acid sequence) of SEQ ID NO: 191, or a fragment thereof. In one embodiment, the NTRK2 fusion polypeptide comprises an amino acid sequence at least 70%, 75%, 80%, 85%, 90%, 91%, 92%, 93%, 94%, 95%, 96%, 97%, 98%, 99%, or 99.5% identical to an amino acid sequence (e.g., a fragment of the amino acid sequence) provided in Table G (e.g., any one of SEQ ID NOs: 108-117) and the amino acid sequence (e.g., a fragment of the amino acid sequence) of SEQ ID NO: 191.

In one embodiment, the NTRK2 fusion polypeptide comprises a sequence containing any of at least about 10, at least about 20, at least about 50, at least about 100, at least about 500, at least about 600, at least about 700, at least about 800, at least about 900, at least about 1000, or more amino acids of an amino acid sequence provided in Table G (e.g., any one of SEQ ID NOs: 108-117) and of the amino acid sequence of SEQ ID NO: 191 in combination. In one embodiment, the NTRK2 fusion polypeptide comprises an amino acid sequence containing any of at least about 5, at least about 10, at least about 20, at least about 50, at least about 100, at least about 500, or more amino acids (e.g., contiguous amino acids) of an amino acid sequence provided in Table G (e.g., any one of SEQ ID NOs: 108-117) and any of at least about 5, at least about 10, at least about 20, at least about 50, at least about 100, at least about 500, or more amino acids (e.g., contiguous amino acids) of the amino acid sequence of SEQ ID NO: 191.

In one embodiment, the NTRK2 fusion polypeptide includes an NTRK2 receptor tyrosine kinase domain (e.g., a TRKB kinase domain) or a functional fragment thereof. In an embodiment, the NTRK2 fusion polypeptide comprises sufficient NTRK2 sequence and sufficient sequence of a polypeptide comprising an amino acid sequence provided in Table G (e.g., any one of SEQ ID NOs: 108-117) such that it has a kinase activity, e.g., has an elevated activity, e.g., an NTRK2 kinase activity, e.g., a TRKB kinase activity, as compared with wildtype NTRK2, e.g., in a cell of a cancer described herein (e.g., a cancer provided in Table J).

In yet other embodiments, the NTRK2 fusion polypeptide comprises an amino acid sequence provided in Table I (e.g., any one of SEQ ID NOs: 124-129), or an amino acid sequence substantially identical thereto (e.g., at least 70%, 75%, 80%, 85%, 90%, 91%, 92%, 93%, 94%, 95%, 96%, 97%, 98%, 99%, or 99.5% identical to the amino acid sequence, or a fragment of the amino acid sequence).

In another aspect, the disclosure provides an NTRK2 fusion polypeptide (e.g., a purified NTRK2 fusion polypeptide), a biologically active or antigenic fragment thereof, as well as reagents (e.g., antibody molecules that bind to an NTRK2 fusion polypeptide), methods for modulating an NTRK2 polypeptide activity, and detection of an NTRK2 polypeptide.

In one embodiment, the NTRK2 fusion polypeptide has at least one biological activity, e.g., an NTRK2 kinase activity (e.g., a TRKB kinase activity). In one embodiment, at least one biological activity of the NTRK2 fusion polypeptide is reduced or inhibited by an anti-cancer drug, e.g., a kinase inhibitor (e.g., a multikinase inhibitor, an NTRK-specific kinase inhibitor, or an NTRK2-specific inhibitor). Exemplary multikinase inhibitors include, e.g., KRC-108, crizotinib, and K252a. In one embodiment, at least one biological activity of the NTRK2 fusion polypeptide is reduced or inhibited by an NTRK kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928. In certain embodiments, the NTRK kinase inhibitor is larotrectinib.

In yet other embodiments, the NTRK2 fusion polypeptide is encoded by a nucleic acid molecule described herein. In one embodiment, the NTRK2 fusion polypeptide is encoded by a nucleic acid comprising an in-frame fusion of an exon provided in the “Last exon of 5' transcript” column of Table H with an exon provided in the “First exon of 3' transcript” column of Table H. In another embodiment, the NTRK2 fusion polypeptide comprises an amino acid sequence encoded by a nucleotide sequence comprising a fusion junction between a transcript provided in Table F (e.g., any one of SEQ ID NOs: 95-107, or any Transcript IDs provided in Table F, and the NTRK2 transcript.

In certain embodiments, the NTRK2 fusion polypeptide comprises at least one encoded exon from a gene provided in Table F (e.g., any one of SEQ ID NOs: 95-107; or any Transcript ID provided in Table F, and at least one exon of NTRK2. In certain embodiments, the NTRK2 fusion polypeptide is encoded by a nucleic acid molecule comprising Breakpoint 1 and/or Breakpoint 2 provided in Table J. In certain embodiments, the NTRK2 fusion polypeptide is encoded by a nucleic acid molecule comprising a rearrangement provided in Table J In certain embodiments, the NTRK2 fusion comprises the amino acid sequence corresponding to at least one exon or a fragment thereof from a gene provided in Table F (e.g., any one of SEQ ID NOs: 95-107, or any Transcript IDs provided in Table F, and the amino acid sequence corresponding to at least one exon or a fragment thereof from NTRK2 (e.g., as shown in SEQ ID NO: 191). In one embodiment, the NTRK2 fusion comprises any of at least 5, at least 10, at least 15, at least 20, or more amino acids from an exon of a gene of Table G (e.g., any one of SEQ ID NOs: 108-117), and any of at least 5, at least 10, at least 15, at least 20, or more amino acids from an exon of NTRK2 (e.g., from the amino acid sequence of NTRK2, e.g., of the amino acid sequence of SEQ ID NO: 191).

In one embodiment, the NTRK2 fusion polypeptide includes an NTRK2 tyrosine kinase domain (e.g., a TRKB kinase domain) or a functional fragment thereof. In a related aspect, the disclosure provides NTRK2 fusion polypeptides or fragments operatively linked to heterologous polypeptides to form fusion proteins.

In another embodiment, the NTRK2 fusion polypeptide or fragment is a peptide, e.g., an immunogenic peptide or protein that contains a fusion junction described herein. Such immunogenic peptides or proteins can be used to raise antibodies specific to a fusion protein. In other embodiments, such immunogenic peptides or proteins can be used for vaccine preparation. The vaccine preparation can include other components, e.g., an adjuvant.

In another aspect, the disclosure features antibody molecules that bind to an NTRK2 fusion polypeptide or fragment described herein. In some embodiments, the antibody can distinguish wildtype NTRK2 or a wild type protein provided in Table G (e.g., a wild type protein comprising the amino acid sequence of any one of SEQ ID NOs: 108-117) from an NTRK2 fusion polypeptide described herein.

Additional NTRK3 Fusions

NTRK3 encodes the receptor tyrosine kinase TRKC, which regulates cell proliferation, differentiation, and survival of neurons by activating several downstream pathways that also play a role in tumorigenesis (e.g., GRB2-RAS-MAPK and RAS-PI3K-AKT1). NTRK3 fusions that include an N-terminal oligomerization-promoting partner gene linked to the kinase domain of TRKC have been characterized as activating, exhibiting constitutive kinase activity and tyrosine phosphorylation. The frequency of NTRK3 fusions is relatively low in common solid tumors and hematological malignancies (<5%) but is much higher in several rare solid tumors (>80%), such as infantile fibrosarcoma and cellular and mixed congenital mesoblastic nephroma (Penault-Llorca et al., 2019; 31072837).

Provided herein are NTRK3 gene fusion molecules that comprise all or part of a gene of Table K and all or part of NTRK3. NTRK3 gene fusion molecules described herein include any fusion molecule (e.g., gene, gene product (e.g., cDNA, mRNA, or polypeptide), and variant thereof) that includes a fragment of a gene of Table K or gene product of a gene of Table K and a fragment of an NTRK3 gene or gene product described herein, including, e.g., an NTRK3 fusion molecule of Tables M, N, and O. As shown in Table O, expression of NTRK3 fusion molecules described herein has been detected in cancer tissues, thus suggesting an association With cancer, e.g., a cancer of Table O.

TABLE K

Nucleotide Sequences of NTRK3 fusion partners.

| Gene | SEQ ID NO | Transcript ID |
|---|---|---|
| ADAMTSL3 | 130 | NM_207517 |
| BLM | 131 | NM_000057 |
| ACAN | 132 | NM_001135 |
| MYO9A | 133 | NM_006901 |
| CDK12 | 134 | NM_015083 |
| CDK12 | 135 | NM_015083 |
| EFTUD1/EFL1 | 136 | NM_024580 |
| EFTUD1 | 137 | NM_024580 |
| LRRK1 | 138 | NM_024652 |
| HMBOX1 | 139 | NM_024567 |
| RUNX1 | 140 | NM_001754 |
| DLG1 | 141 | NM_004087 |
| AMMECR1 | 142 | NM_015365 |
| TNRC6A | 143 | NM_014494 |
| IQGAP1 | 144 | NM_003870 |

TABLE K-continued

| Nucleotide Sequences of NTRK3 fusion partners. | | |
|---|---|---|
| Gene | SEQ ID NO | Transcript ID |
| RORA | 145 | NM_134262 |
| CHST11 | 146 | NM_018413 |
| ZSCAN2 | 147 | NM_017894 |
| FANCI | 148 | NM_018193 |
| PKM | 149 | NM_002654 |
| CARM1 | 7 | NM_199141.2 |

TABLE L

| Amino Acid Sequences of NTRK3 fusion partners. | |
|---|---|
| Gene | SEQ ID NO |
| ADAMTSL3 | 150 |
| BLM | 151 |
| ACAN | 152 |

TABLE L-continued

| Amino Acid Sequences of NTRK3 fusion partners. | |
|---|---|
| Gene | SEQ ID NO |
| MYO9A | 153 |
| CDK12 | 154 |
| EFTUD1/EFL1 | 155 |
| LRRK1 | 156 |
| HMBOX1 | 157 |
| RUNX1 | 158 |
| DLG1 | 159 |
| AMMECR1 | 160 |
| TNRC6A | 161 |
| IQGAP1 | 162 |
| RORA | 163 |
| CHST11 | 164 |
| ZSCAN2 | 165 |
| FANCI | 166 |
| PKM | 167 |
| CARM1 | 8 |

TABLE M

| Nucleotide Sequences of NTRK3 fusions. | | | | | |
|---|---|---|---|---|---|
| Fusion | 5' Transcript ID | Last exon of 5' transcript | 3' Transcript ID | First exon of 3' transcript | SEQ ID NO |
| BLM-NTRK3 | NM_000057 | exon 3 | NM_002530 | exon 14 | 168 |
| NTRK3-EFTUD1 | NM_002530 | exon 11 | NM_024580 | exon 17 | 169 |
| NTRK3-LRRK1 | NM_002530 | exon 5 | NM_024652 | exon 21 | 170 |
| HMBOX1-NTRK3 | NM_024567 | 5 | NM_002530 | 14 | 171 |
| RUNX1-NTRK3 | NM_001754 | 5 | NM_002530 | 8 | 172 |
| DLG1-NTRK3 | NM_004087 | 10 | NM_002530 | 11 | 173 |
| AMMECR1-NTRK3 | NM_015365 | 2 | NM_002530 | 6 | 174 |
| TNRC6A-NTRK3 | NM_014494 | 4 | NM_002530 | 15 | 175 |
| IQGAP1-NTRK3 | NM_003870 | 9 | NM_002530 | 11 | 176 |
| CARM1-NTRK3 | NM199141.2 | 3 | NM_002530 | 3 | 11 |

TABLE N

| Amino Acid Sequences of NTRK3 fusions. | |
|---|---|
| Fusion | SEQ ID NO |
| BLM-NTRK3 | 177 |
| NTRK3-EFTUD1 | 178 |
| NTRK3-LRRK1 | 179 |
| HMBOX1-NTRK3 | 180 |
| RUNX1-NTRK3 | 181 |
| DLG1-NTRK3 | 182 |
| AMMECR1-NTRK3 | 183 |
| TNRC6A-NTRK3 | 184 |
| IQGAP1-NTRK3 | 185 |
| CARM1-NTRK3 | 12 |

TABLE O

| NTRK3 fusion breakpoints. | | | | |
|---|---|---|---|---|
| Fusion (5'-3') | Breakpoint 1 | Breakpoint 2 | Cancer Type | Rearrangement |
| NTRK3-ADAMTSL3 | 88576047-88576349 on chromosome 15 | 84564247-84564478 on chromosome 15 | Soft tissue sarcoma (NOS) | Inversion; NTRK3 (last exon for 5' transcript [NM_002530]: exon 14)-ADAMTSL3 (first exon of 3' transcript[NM_207517]: exon 14); FIGS. 20A-20B |

TABLE O-continued

NTRK3 fusion breakpoints.

| Fusion (5'-3') | Breakpoint 1 | Breakpoint 2 | Cancer Type | Rearrangement |
|---|---|---|---|---|
| BLM-NTRK3 | 88576055-88576336 on chromosome 15 | 91294841-91295039 on chromosome 15 | Esophagus adenocarcinoma | Inversion; FIGS. 24B-24C |
| NTRK3-ACAN | 88680708-88680926 on chromosome 15 | 89376765-89377051 on chromosome 15 | Bladder adenocarcinoma | Inversion; NTRK3 (last exon of 5' transcript [NM_002530]: exon 7)-ACAN (First exon of 3' transcript [NM_001135]: exon 2). |
| MYO9A-NTRK3 | 88678239-88678576 on chromosome 15 | 72373590-72373836 on chromosome 15 | Breast carcinoma (NOS) | Duplication; MYO9A (last exon of 5' transcript [NM_006901]: exon 1)-NTRK3 (first exon of 3' transcript [NM_002530]: exon 10). |
| NTRK3-CDK12 | chr15: 88598687 | chr17: 37667760 | Breast carcinoma (NOS) | Chr15: Chr17 translocation; NTRK3(exons 1-13 NM_002530)-CDK12(exons 8-14 NM_015083); breakpoints NTRK3 intron 13, CDK12 intron 7. |
| NTRK3-EFTUD1 | chr15: 88671888 | chr15: 82450990 | Breast invasive ductal carcinoma (IDC) | Deletion; NTRK3(exons 1-11 NM_002530)-EFTUD1(exons 17-20 NM_024580); breakpoints: NTRK3 intron 11, EFTUD1 intron 16. |
| NTRK3-LRRK1 | 88726672-88726712 on chromosome 15 | 101586177-101586217 on chromosome 15 | Uterus adenosarcoma | Inversion; FIGS. 28B-28C. |
| HMBOX1-NTRK3 | chr8: 28837673 | chr15: 88576276 | PEDIATRIC Soft tissue sarcoma (NOS) | Chr8: Chr15 translocation; HMBOX1(exons 1-5 NM_024567)-NTRK3(exons 14-19 NM_002530); Reciprocal: no. |
| RUNX1-NTRK3 | chr21: 36245517 | chr15: 88679930 | Liver cholangiocarcinoma | Chr21: Chr15 translocation; RUNX1(exons 1-5 NM_001754)-NTRK3(exons 8-19 NM_002530); breakpoints: RUNX1 intron 5, NTRK3 intron 7. |
| DLG1-NTRK3 | chr3: 196864576 | chr15: 88672048 | Brain glioblastoma (GBM) | Chr3: Chr15 translocation; DLG1 (exons 1-10 NM_004087)-NTRK3 (exons 11-19 NM_002530); breakpoints: DLG1 intron 10, NIRK3 intron 10. |
| AMMECR1-NTRK3 | Chr10: 109507730-109507770 | chr15: 88680710-88680750 | Unknown primary leiomyosarcoma | Chr10: Chr15 translocation; AMMECR1(exons 1-2 NM_015365)-NTRK3(exons 6-19 NM_002530); Reciprocal: no. |
| TNRC6A-NTRK3 | chr16: 24787413 | chr15: 88521762 | Head and neck squamous cell carcinoma (HNSCC) | Chr16: Chr15 translocation; TNRC6A(exons 1-4 NM_014494)-NTRK3(exons 15-19 NM_002530); |

TABLE O-continued

NTRK3 fusion breakpoints.

| Fusion (5'-3') | Breakpoint 1 | Breakpoint 2 | Cancer Type | Rearrangement |
|---|---|---|---|---|
| | | | | breakpoints: TNRC6A intron 4, NTRK3 intron 14; Reciprocal: Yes. |
| IQGAP1-NTRK3 | chr15: 90986710 | chr15: 88670393 | Soft tissue malignant peripheral nerve sheath tumor (MPNST) | Fusion; IQGAP1(exons 1-9 NM_003870)-NTRK3(exons 11-19 NM_002530); Reciprocal: no. |
| RORA-NTRK3 | chr15: 60884583-60884623 | chr15: 88423564-88423604 | Soft tissue liposarcoma | Fusion; RORA (exon 1 NM_134262)-NTRK3 (exon 18-end NM_002530); reciprocal: no. |
| CHST11-NTRK3 | chr12: 104995770 | chr15: 88727530 | Soft tissue liposarcoma | Chr12: Chr15 translocation; CHST11(exons 1-2 NM_018413)-NTRK3(exons 4-19 NM_002530); Reciprocal: no. |
| ZSCAN2-NTRK3 | chr15: 85147564 | chr15: 88690634 | Soft tissue sarcoma (NOS) | Fusion; ZSCAN2(exons 1-2 NM_017894)-NTRK3(exons 6-19 NM_002530); Reciprocal: no. |
| FANCI-NTRK3 | chr15: 89790962 | chr15: 88726720 | Soft tissue leiomyosarcoma | Fusion; FANCI(exons 1-2 NM_018193)-NTRK3(exons 2-19 NM_002530); Reciprocal: No. |
| PKM-NTRK3 | chr15: 72523457 | chr15: 88727530 | Bone osteosarcoma | Fusion; PKM(exons 1-1 UTR NM_002654)-NTRK3(exons 4-19 NM_002530); Reciprocal: no; FIGS. 35A-35B |
| CARM1-NTRK3 | 88799136-88799434 on Chromosome 15 | 11019501-11019751 on Chromosome 19 | Vaginal melanoma | Chr15: 19 translocation |

In one embodiment, the NTRK3 fusion molecule includes an in-frame fusion of an exon of a gene of Table K, e.g., one more exons of a gene of Table K (e.g., as described in Tables M or O) or a fragment thereof, and one or more exons of NTRK3, e.g., one or more exons of an NTRK3 gene, e.g., having a sequence provided in FIG. 10 (SEQ ID NO: 9), or FIG. 38A (SEQ ID NO: 192), or a fragment thereof, e.g., as described in Tables M or O. In some embodiments, the NTRK3 fusion molecule includes all or part of at least one exon of a nucleotide sequence of any one of SEQ ID NOs: 7 or 130-149, or of a nucleotide sequence substantially identical thereto (e.g., at least 70%, 75%, 80%, 85%, 90%, 91%, 92%, 93%, 94%, 95%, 96%, 97%, 98%, 99%, or 99.50 identical thereto). In some embodiments, the NTRK3 fusion molecule includes all or part of at least one exon of a Transcript ID shown in Tables K, M, or O or of a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto), or all or part of at least one exon of a Transcript ID provided in Table K, or of a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto).

In some embodiments, the NTRK3 fusion molecule comprises an in-frame fusion of an exon provided in the "Last exon of 5' transcript" column of Table M with an exon provided in the "First exon of 3' transcript" column of Table M.

In another embodiment, the fusion molecule includes the nucleotide sequence of any one of SEQ ID NOs: 11 or 168-176 or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion molecule encodes the amino acid sequence of any one of SEQ ID NOs: 12 or 177-185, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In some embodiments, the NTRK3 fusion molecule can include an in-frame fusion within an intron of a gene of Table K (e.g., as described in Tables M or O) or a fragment thereof, with an intron of NTRK3 (e.g., as described in Tables M or O) or a fragment thereof. In some embodiments, the NTRK3 fusion comprises a Breakpoint 1 and/or a Breakpoint 2 of Table O. In some embodiments, the NTRK3 fusion comprises a rearrangement of Table O. In some embodiments, the NTRK3 fusion is a rearrangement described in Table O.

The term "fusion" or "fusion molecule" can refer to a fusion polypeptide or a fusion nucleic acid/fusion nucleic acid molecule, depending on the context. It may include a full-length sequence of a fusion or a fragment thereof, e.g., a fragment comprising a fusion junction (e.g., a fragment including a portion of a gene of Table K and a portion of NTRK3, e.g., a portion of an NTRK3 fusion molecule described herein, e.g., as described in Table M). In one embodiment, an NTRK3 fusion polypeptide includes a fragment of the amino acid sequence of SEQ ID NO: 10 (e.g., as shown in FIG. 11) or SEQ ID NO: 193 (e.g., as shown in FIG. 38B), or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto) and a fragment of the amino acid sequence of any one of SEQ ID NOs: 8 or 150-167 shown, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the NTRK3 fusion polypeptide includes the amino acid sequence of any one of SEQ ID NOs: 12 or 177-185, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In another embodiment, the NTRK3 fusion nucleic acid molecule includes a fragment of a nucleotide sequence of Table K and a fragment of the nucleotide sequence shown in FIG. 10 (SEQ ID NO: 9) or in FIG. 38A (SEQ ID NO: 192), or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes the nucleotide sequence of any one of SEQ ID NOs: 11 or 168-176 or a nucleotide sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the fusion nucleic acid molecule includes a nucleotide sequence encoding the amino acid sequence of any one of SEQ ID NOs: 12 or 177-185, or an amino acid sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the NTRK3 fusion polypeptide comprises sufficient sequence of an amino acid sequence of Table L (e.g., any one of SEQ ID NOs: 8 or 150-167) and sufficient NTRK3 sequence (e.g., of FIG. 11 or SEQ ID NO: 10, or of FIG. 38B or SEQ ID NO: 193) such that the fusion (e.g., a fusion of Table N, e.g., comprising the sequence of any one of SEQ ID NOs: 12 or 177-185) has a kinase activity, e.g., has an elevated (e.g., constitutive) activity, e.g., an NTRK3 tyrosine kinase activity, e.g., a TRKC kinase activity, as compared with wildtype NTRK3, e.g., in a cell of a cancer described to herein (e.g., a cancer described herein or provided in Table O).

In some embodiments, the NTRK3 fusion comprises a fusion shown in Table M, wherein the genes in the Fusion are provided in the 5' to 3' direction. In some embodiments, the NTRK3 fusion comprises any of at least 1, at least 5, at least 10, at least 15, at least 20, at least 25, at least 30, at least 40, at least 50, or more amino acids of an exon shown in the "Last exon of 5' transcript" column of Table M, and any of at least 1, at least 5, at least 10, at least 15, at least 20, at least 25, at least 30, at least 40, at least 50, or more amino acids of an exon shown in the "First exon of 3' transcript" column of Table M.

In some embodiments, the NTRK3 fusion comprises a fusion shown in Table M, wherein the genes in the Fusion are provided in the 5' to 3' direction. In some embodiments, the NTRK3 fusion comprises any of at least 3, at least 6, at least 12, at least 15, at least 20, at least 25, at least 50, at least 75, at least 100, or more nucleotides of an exon shown in the "Last exon of 5' transcript" column of Table M, and any of at least 3, at least 6, at least 12, at least 15, at least 20, at least 25, at least 50, at least 75, at least 100, or more nucleotides of an exon shown in the "First exon of 3' transcript" column of Table M.

In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of ADAMTSL3 (e.g., having the nucleotide sequence of SEQ ID NO: 130 or of Transcript ID NM_207517, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of BLM (e.g., having the nucleotide sequence of SEQ ID NO: 131 or of Transcript ID NM_000057, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of ACAN (e.g., having the nucleotide sequence of SEQ ID NO: 132 or of Transcript ID NM_001135, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of MYO9A (e.g., having the nucleotide sequence of SEQ ID NO: 133 or of Transcript ID NM_006901, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97% 98%, 99%, or 99.5% identical thereto) and all or a part of CDK12 (e.g., having the nucleotide sequence of SEQ ID NO: 134 or of Transcript ID NM_015083, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of CDK12 (e.g., having the nucleotide sequence of SEQ ID NO: 135 or of Transcript ID NM_015083, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of EFTUD1/EFL1 (e.g., having the nucleotide sequence of SEQ ID NO: 136 or of Transcript ID NM_024580, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97% 98%, 99%, or 99.5% identical thereto) and all or a part of EFTUD1 (e.g., having the nucleotide sequence of SEQ ID NO: 137 or of Transcript ID NM_024580, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of LRRK1 (e.g., having the nucleotide sequence of SEQ ID NO: 138 or of Transcript ID NM_024652, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of HMBOX1 (e.g., having the nucleotide sequence of SEQ ID NO: 139 or of Transcript ID NM_024567, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of RUNX1 (e.g., having the nucleotide sequence of SEQ ID NO: 140 or of Transcript ID NM_001754, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of DLG1 (e.g., having the nucleotide sequence of SEQ ID NO: 141 or of Transcript ID NM_004087, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of AMMECR1 (e.g., having the nucleotide sequence of SEQ ID NO: 142 or of Transcript ID NM_015365, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of TNRC6A (e.g., having the nucleotide sequence of SEQ ID NO: 143 or of Transcript ID NM_014494, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of IQGAP1 (e.g., having the nucleotide sequence of SEQ ID NO: 144 or of Transcript ID NM_003870, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of RORA (e.g., having the nucleotide sequence of SEQ ID NO: 145 or of Transcript ID NM_134262, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of CHST11 (e.g., having the nucleotide sequence of SEQ ID NO: 146 or of Transcript ID NM_018413, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of ZSCAN2 (e.g., having the nucleotide sequence of SEQ ID NO: 147 or of Transcript ID NM_017894, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of FANCI (e.g., having the nucleotide sequence of SEQ ID NO: 148 or of Transcript ID NM_018193, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of all or a part of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and all or a part of PKM (e.g., having the nucleotide sequence of SEQ ID NO: 149 or of Transcript ID NM_002654, or a nucleotide sequence at least 70%, 75%, 80%, 85%, 90%, 91%, 92%, 93%, 94% 95%, 96%, 97%, 98%, 99%, or 99.5% identical thereto).

In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of ADAMTSL3 (e.g., having the nucleotide sequence of SEQ ID NO: 130 or of Transcript ID NM_207517, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of BLM (e.g., having the nucleotide sequence of SEQ ID NO: 131 or of Transcript ID NM_000057, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of ACAN (e.g., having the nucleotide sequence of SEQ ID NO: 132 or of Transcript ID NM_001135, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of MYO9A (e.g., having the nucleotide sequence of SEQ ID NO: 133 or of Transcript ID NM_006901, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of CDK12 (e.g., having the nucleotide sequence of SEQ ID NO: 134 or of Transcript ID NM_015083, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of CDK12 (e.g., having the nucleotide sequence of SEQ ID NO: 135 or of Transcript ID NM_015083, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of EFTUD1/EFL1 (e.g., having the nucleotide sequence of SEQ ID NO: 136 or of Transcript ID NM_024580, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of EFTUD1 (e.g., having the nucleotide sequence of SEQ ID NO: 137 or of Transcript ID NM_024580, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of LRRK1 (e.g., having the nucleotide sequence of SEQ ID NO: 138 or of Transcript ID NM_024652, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of HMBOX1 (e.g., having the nucleotide sequence of SEQ ID NO: 139 or of Transcript ID NM_024567, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of RUNX1 (e.g., having the nucleotide sequence of SEQ ID NO: 140 or of Transcript ID NM_001754, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of DLG1 (e.g., having the nucleotide sequence of SEQ ID NO: 141 or of Transcript ID NM_004087, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of AMMECR1 (e.g., having the nucleotide sequence of SEQ ID NO: 142 or of Transcript ID NM_015365, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of TNRC6A (e.g., having the nucleotide sequence of SEQ ID NO: 143 or of Transcript ID NM_014494, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of IQGAP1 (e.g., having the nucleotide sequence of SEQ ID NO: 144 or of Transcript ID NM_003870, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of RORA (e.g., having the nucleotide sequence of SEQ ID NO: 145 or of Transcript ID NM_134262, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of CHST11 (e.g., having the nucleotide sequence of SEQ ID NO: 146 or of Transcript ID NM_018413, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of ZSCAN2 (e.g., having the nucleotide sequence of SEQ ID NO: 147 or of Transcript ID NM_017894, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of FANCI (e.g., having the nucleotide sequence of SEQ ID NO: 148 or of Transcript ID NM_018193, or a nucleotide sequence at least 70%, 75%, 80%, 85%, 90%, 91%, 92%, 93%, 94% 95%, 96%, 97%, 98%, 99%, or 99.5% identical thereto). In some embodiments, an NTRK3 fusion provided herein comprises a fusion of one or more exons of an NTRK3 gene (e.g., an NTRK3 gene provided herein, e.g., having a nucleotide sequence of any of SEQ ID NOs: 9 or 192, or a nucleotide sequence at least 70%, 75%, 80%, 85%, 90%, 91%, 92%, 93%, 94% 95%, 96%, 97%, 98%, 99%, or 99.5% identical thereto) and one or more exons of PKM (e.g., having the nucleotide sequence of SEQ ID NO: 149 or of Transcript ID NM_002654, or a nucleotide sequence at least 70%, 75%, 80%, 85%, 90%, 91%, 92%, 93%, 94% 95%, 96%, 97%, 98%, 99%, or 99.5% identical thereto).

In some embodiments, a BLM-NTRK3 fusion provided herein comprises the nucleotide sequence of SEQ ID NO: 168, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK3-EFTUD1 fusion provided herein comprises the nucleotide sequence of SEQ ID NO: 169, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK3-LRRK1 fusion provided herein comprises the nucleotide sequence of SEQ ID NO: 170, or a nucleotide sequence at least 70%, 75%, 80%, 85%, 90%, 91%, 92%, 93%, 94% 95%, 96%, 97%, 98%, 99%, or 99.5% identical thereto. In some embodiments, a HMBOX1-NTRK3 fusion provided herein comprises the nucleotide sequence of SEQ ID NO: 171, or a nucleotide sequence at least 70%, 75%, 80%, 85%, 90%, 91%, 92%, 93%, 94% 95%, 96%, 97%, 98%, 99%, or 99.5% identical thereto. In some embodiments, a RUNX1-NTRK3 fusion provided herein comprises the nucleotide sequence of SEQ ID NO: 172, or a nucleotide sequence at least 70%, 75%, 80%, 85%, 90%, 91%, 92%, 93%, 94% 95%, 96%, 97%, 98%, 99%, or 99.5% identical thereto. In some embodiments, a DLG1-NTRK3 fusion provided herein comprises the nucleotide sequence of SEQ ID NO: 173, or a nucleotide sequence at least 70%, 75%, 80%, 85%, 90%, 91%, 92%, 93%, 94% 95%, 96%, 97%, 98%, 99%, or 99.5% identical thereto. In some embodiments, a AMMECR1-NTRK3 fusion provided herein comprises the nucleotide sequence of SEQ ID NO: 174, or a nucleotide sequence at least 70%, 75%, 80%, 85%, 90%, 91%, 92%, 93%, 94% 95%, 96%, 97%, 98%, 99%, or 99.5% identical thereto. In some embodiments, a TNRC6A-NTRK3 fusion provided herein comprises the nucleotide sequence of SEQ ID NO: 175, or a nucleotide sequence at least 70%, 75%, 80%, 85%, 90%, 91%, 92%, 93%, 94% 95%, 96%, 97%, 98%, 99%, or 99.5% identical thereto. In some embodiments, an IQGAP1-NTRK3 fusion provided herein comprises the nucleotide sequence of SEQ ID NO: 176, or a nucleotide sequence at least 70%, 75%, 80%, 85%, 90%, 91%, 92%, 93%, 94% 95%, 96%, 97%, 98%, 99%, or 99.5% identical thereto.

In some embodiments, a BLM-NTRK3 fusion provided herein comprises a nucleotide sequence encoding an amino acid sequence of SEQ ID NO: 177, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK3-EFTUD1 fusion provided herein comprises a nucleotide sequence encoding an amino acid sequence of SEQ ID NO: 178, or a nucleotide sequence at least 70%, 75%, 80%, 85%, 90%, 91%, 92%, 93%, 94% 95%, 96%, 97%, 98%, 99%, or 99.5% identical thereto. In some embodiments, a NTRK3-LRRK1 fusion provided herein comprises a nucleotide sequence encoding an amino acid sequence of SEQ ID NO: 179, or a nucleotide sequence at least 70%, 75%, 80%, 85%, 90%, 91%, 92%, 93%, 94% 95%, 96%, 97%, 98%, 99%, or 99.5% identical thereto. In some embodiments, a HMBOX1-NTRK3 fusion provided herein comprises a nucleotide sequence encoding an amino acid sequence of SEQ ID NO: 180, or a nucleotide sequence at least 70%, 75%, 80%, 85%, 90%, 91%, 92%, 93%, 94% 95%, 96%, 97%, 98%, 99%, or 99.5% identical thereto. In some embodiments, a RUNX1-NTRK3 fusion provided herein comprises a nucleotide sequence encoding an amino acid sequence of SEQ ID NO: 181, or a nucleotide sequence at least 70%, 75%, 80%, 85%, 90%, 91%, 92%, 93%, 94% 95%, 96%, 97%, 98%, 99%, or 99.5% identical thereto. In some embodiments, a DLG1-NTRK3 fusion provided herein comprises a nucleotide sequence encoding an amino acid sequence of SEQ ID NO: 182, or a nucleotide sequence at least 70%, 75%, 80%, 85%, 90%, 91%, 92%, 93%, 94% 95%, 96%, 97%, 98%, 99%, or 99.5% identical thereto. In some embodiments, an AMMECR1-NTRK3 fusion provided herein comprises a nucleotide sequence encoding an amino acid sequence of SEQ ID NO: 183, or a nucleotide sequence at least 70%, 75%, 80%, 85%, 90%, 91%, 92%, 93%, 94% 95%, 96%, 97%, 98%, 99%, or 99.5% identical thereto. In some embodiments, a TNRC6A-NTRK3 fusion provided herein comprises a nucleotide sequence encoding an amino acid sequence of SEQ ID NO: 184, or a nucleotide sequence at least 70%, 75%, 80%, 85%, 90%, 91%, 92%, 93%, 94% 95%, 96%, 97%, 98%, 99%, or 99.5% identical thereto. In some embodiments, an IQGAP1-NTRK3 fusion provided herein comprises a nucleotide sequence encoding an amino acid sequence of SEQ ID NO: 185, or a nucleotide sequence at least 70%, 75%, 80%, 85%, 90%, 91%, 92%, 93%, 94% 95%, 96%, 97%, 98%, 99%, or 99.5% identical thereto.

In some embodiments, a NTRK3-ADAMTSL3 fusion provided herein comprises, in the 5' to 3' direction, a Breakpoint 1 of 88576047-88576349 on chromosome 15 and a Breakpoint 2 of 84564247-84564478 on chromosome 15. In some embodiments, a BLM-NTRK3 fusion provided herein comprises, in the 5' to 3' direction, a Breakpoint 1 of 88576055-88576336 on chromosome 15 and a Breakpoint 2 of 91294841-91295039 on chromosome 15. In some embodiments, a NTRK3-ACAN fusion provided herein comprises, in the 5' to 3' direction, a Breakpoint 1 of 88680708-88680926 on chromosome 15 and a Breakpoint 2 of 89376765-89377051 on chromosome 15. In some embodiments, a MYO9A-NTRK3 fusion provided herein comprises, in the 5' to 3' direction, a Breakpoint 1 of 88678239-88678576 on chromosome 15 and a Breakpoint 2 of 72373590-72373836 on chromosome 15. In some embodiments, a NTRK3-CDK12 fusion provided herein comprises, in the 5' to 3' direction, a Breakpoint 1 of chr15:88598687 and a Breakpoint 2 of chr17:37667760. In some embodiments, a NTRK3-EFTUD1 fusion provided herein comprises, in the 5' to 3' direction, a Breakpoint 1 of chr15:88671888 and a Breakpoint 2 of chr15:82450990. In some embodiments, a NTRK3-LRRK1 fusion provided herein comprises, in the 5' to 3' direction, a Breakpoint 1 of 88726672-88726712 on chromosome 15 and a Breakpoint 2 of 101586177-101586217 on chromosome 15. In some embodiments, a HMBOX1-NTRK3 fusion provided herein comprises, in the 5' to 3' direction, a Breakpoint 1 of chr8:28837673 and a Breakpoint 2 of chr15:88576276. In some embodiments, a RUNX1-NTRK3 fusion provided herein comprises, in the 5' to 3' direction, a Breakpoint 1 of chr21:36245517 and a Breakpoint 2 of chr15:88679930. In some embodiments, a DLG1-NTRK3 fusion provided herein comprises, in the 5' to 3' direction, a Breakpoint 1 of chr3:196864576 and a Breakpoint 2 of chr15:88672048. In some embodiments, an AMMECR1-NTRK3 fusion provided herein comprises, in the 5' to 3' direction, a Breakpoint 1 of Chr10:109507730-109507770 and a Breakpoint 2 of chr15:88680710-88680750. In some embodiments, a TNRC6A-NTRK3 fusion provided herein comprises, in the 5' to 3' direction, a Breakpoint 1 of chr16:24787413 and a Breakpoint 2 of chr15:88521762. In some embodiments, an IQGAP1-NTRK3 fusion provided herein comprises, in the 5' to 3' direction, a Breakpoint 1 of chr15:90986710 and a Breakpoint 2 of chr15:88670393. In some embodiments, a RORA-NTRK3 fusion provided herein comprises, in the 5' to 3' direction, a Breakpoint 1 of chr15:60884583-60884623 and a Breakpoint 2 of chr15:88423564-88423604. In some embodiments, a CHST11-NTRK3 fusion provided herein comprises, in the 5' to 3' direction, a Breakpoint 1 of chr12:104995770 and a Breakpoint 2 of chr15:88727530. In some embodiments, a ZSCAN2-NTRK3 fusion provided herein comprises, in the 5' to 3' direction, a Breakpoint 1 of chr15:85147564 and a Breakpoint 2 of chr15:88690634. In some embodiments, a FANCI-NTRK3 fusion provided herein comprises, in the 5' to 3' direction, a Breakpoint 1 of chr15:89790962 and a Breakpoint 2 of chr15:88726720. In some embodiments, a PKM-NTRK3 fusion provided herein comprises, in the 5' to 3' direction, a Breakpoint 1 of chr15:72523457 and a Breakpoint 2 of chr15:88727530.

NTRK3 Fusion Nucleic Acid Molecules

In one aspect, provided herein are nucleic acid molecules (e.g., an isolated or purified nucleic acid molecule) that comprising a fragment of a gene of Table K and a fragment of an NTRK3 gene. In one embodiment, the fusion nucleic acid molecule includes a nucleotide sequence encoding an NTRK3 fusion polypeptide provided herein (e.g., as shown in Table N) that includes an NTRK3 tyrosine kinase domain or a functional fragment thereof, e.g., a TRKC kinase domain or a functional fragment thereof. In other embodiments, the fusion nucleic acid molecule includes a nucleotide sequence encoding a fragment of a polypeptide of Table L or a fragment thereof or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding a fragment of a polypeptide of any one of SEQ ID NOs: 8 or 150-167 or a fragment thereof or a sequence substantially identical thereto (e.g., at least 70%, 75%, 80%, 85%, 90%, 91%, 92%, 93%, 94%, 95%, 96%, 97%, 98%, 99%, or 99.5% identical thereto). In another embodiment, the fusion nucleic acid molecule includes a nucleotide sequence encoding a fragment of the NTRK3 polypeptide including the amino acid sequence of SEQ ID NO: 10 or SEQ ID NO: 193 or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding an amino acid sequence provided in Table L (e.g., any one of SEQ ID NOs: 8 or 150-167), or a fragment thereof, and the amino acid sequence shown in FIG. 11 (SEQ ID NO: 10) or in FIG. 38B (SEQ ID NO: 193), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In other embodiments, the fusion nucleic acid molecule includes a nucleotide sequence encoding an amino acid sequence provided in Table N (e.g., any one of SEQ ID NOs: 12 or 177-185), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto). In one embodiment, the NTRK3 nucleic acid molecule includes a fusion, e.g., resulting in an in-frame fusion, between an intron of a gene of Table K (e.g., as described in Tables M or O) and an intron of NTRK3 (e.g., as described in Tables M or O). In some embodiments, the NTRK3 fusion nucleic acid molecule comprises a Breakpoint 1 and/or a Breakpoint 2 provided in Table O. In some embodiments, the NTRK3 fusion nucleic acid molecule comprises a rearrangement provided in Table O.

In another embodiment, the NTRK3 fusion nucleic acid molecule comprises a nucleotide sequence (e.g., a fragment of a nucleotide sequence) shown in Table K (e.g., any one of SEQ ID NOs: 7 or 130-149) and a nucleotide sequence (e.g., a fragment of a nucleotide sequence) shown in FIG. 10 (SEQ ID NO: 9), or in FIG. 38A (SEQ ID NO: 192), or a fragment of the fusion nucleic acid molecule. In one embodiment, the NTRK3 fusion nucleic acid molecule comprises a nucleotide sequence substantially identical to a nucleotide sequence (e.g., a fragment of a nucleotide sequence) shown in Table K (e.g., any one of SEQ ID NOs: 7 or 130-149) and a nucleotide sequence substantially identical to the nucleotide sequence (e.g., a fragment of a nucleotide sequence) shown in FIG. 10 (SEQ ID NO: 9), or in FIG. 38A (SEQ ID NO: 192). In another embodiment, the NTRK3 fusion nucleic acid molecule comprises a nucleotide sequence (e.g., a fragment of a nucleotide sequence) shown in Table M (e.g., any one of SEQ ID NOs: 11 or 168-176), or a fragment thereof. In one embodiment, the NTRK3 fusion nucleic acid molecule comprises a nucleotide sequence substantially identical to a nucleotide sequence (e.g., a fragment of a nucleotide sequence) shown in Table M (e.g., any one of SEQ ID NOs: 11 or 168-176), or a fragment thereof.

In one embodiment, the NTRK3 fusion nucleic acid molecule comprises a nucleotide sequence at least 70%, 75%, 80%, 85%, 90%, 91%, 92%, 93%, 94%, 95%, 96%, 97%, 98%, 99%, or 99.5% identical to a nucleotide sequence (e.g., a fragment of a nucleotide sequence) provided in Table K (e.g., any one of SEQ ID NOs: 7 or 130-149) and to the nucleotide sequence (e.g., a fragment of a nucleotide sequence) shown in FIG. 10 (SEQ ID NO: 9), or in FIG. 38A (SEQ ID NO: 192). In yet other embodiments, the NTRK3 fusion nucleic acid molecule comprises A nucleotide sequence of Table C (e.g., any one of SEQ ID NOs: 11 or 168-176), or a fragment thereof, or a nucleotide sequence substantially identical thereto (e.g., at least 70%, 75%, 80%, 85%, 90%, 91%, 92%, 93%, 94%, 95%, 96%, 97%, 98%, 99%, or 99.5% identical to the nucleotide sequence, or a fragment of a nucleotide sequence). In one embodiment, the NTRK3 fusion nucleic acid molecule comprises a nucleotide sequence containing at least 25, 50, 100, 150, 200, 500, 1000, 1500, 2000, 2500, 3000, 4000, 5000, 6000, or more nucleotides of a nucleotide sequence shown in Table K (e.g., any one of SEQ ID NOs: 7 or 130-149) and a nucleotide sequence containing at least 25, 50, 100, 150, 200, 500, 1000, 1500, 2000, 2500, or more nucleotides of the nucleotide sequence shown in FIG. 10 (SEQ ID NO: 9), or in FIG. 38A (SEQ ID NO: 192). In one embodiment, the NTRK3 fusion nucleic acid molecule comprises a nucleotide sequence containing at least 25, 50, 100, 150, 200, 500, 1000, 1500, 2000, 2500, 3000, 4000, 5000, 6000, or more nucleotides (e.g., contiguous nucleotides) of a nucleotide sequence shown in Table K (e.g., any one of SEQ ID NOs: 7 or 130-149) and a nucleotide sequence containing at least 25, 50, 100, 150, 200, 500, 1000, 1500, 2000, 2500, or more nucleotides of the nucleotide sequence shown in FIG. 10 (SEQ ID NO: 9), or in FIG. 38A (SEQ ID NO: 192).

In another embodiment, the nucleic acid molecule includes a fusion, e.g., resulting in an in-frame fusion, of at least one exon of a gene (or of a Transcript ID) provided in Table K or a fragment thereof and at least one exon or a fragment thereof of NTRK3 or a fragment thereof. In yet other embodiments, the nucleic acid molecule includes a fragment of a nucleotide sequence shown in Table K (e.g., any one of SEQ ID NOs: 7 or 130-149) and a fragment of the nucleotide sequence shown in FIG. 10 (SEQ ID NO: 9), or in FIG. 38A (SEQ ID NO: 192), or a sequence substantially identical thereto (e.g., at least 70%, 75%, 80%, 85%, 90%, 91%, 92%, 93%, 94%, 95%, 96%, 97%, 98%, 99%, or 99.5% identical thereto), or a nucleotide sequence shown in Table M (e.g., any one of SEQ ID NOs: 11 or 168-176), or a fragment thereof, or a sequence substantially identical thereto (e.g., at least 70%, 75%, 80%, 85%, 90%, 91%, 92%, 93%, 94%, 95%, 96%, 97%, 98%, 99%, or 99.5% identical thereto).

In one embodiment, the nucleic acid molecule is complementary to at least a portion of a nucleotide sequence disclosed herein, e.g., is capable of hybridizing under a stringency condition described herein to a nucleotide sequence of SEQ ID NO: 9 or SEQ ID NO: 192 and/or to a nucleotide sequence provided in Table K or Table M (e.g., any one of SEQ ID NOs: 7 or 130-149 or 11 or 168-176), or a fragment of any of the aforesaid nucleic acid sequences. In yet another embodiment, the nucleic acid molecule hybridizes to a nucleotide sequence that is complementary to at least a portion of a nucleotide sequence disclosed herein, e.g., is capable of hybridizing under a stringency condition to a nucleotide sequence of SEQ ID NO: 9 or SEQ ID NO: 192 and/or to a nucleotide sequence provided in Table K or Table M (e.g., any one of SEQ ID NOs: 7 or 130-149 or 11 or 168-176), or a fragment thereof. The nucleotide sequence of a cDNA encoding exemplary NTRK3 fusions are shown in Table M (e.g., any one of SEQ ID NOs: 11 or 168-176), and the predicted amino acid sequences are shown in Table N (e.g., any one of SEQ ID NOs: 12 or 177-185).

In some embodiments, the NTRK3 nucleic acid molecule comprises sufficient nucleic acid sequence of a gene provided in Table K (e.g., any one of SEQ ID NOs: 7 or 130-149; or any Transcript ID provided in Table K, and sufficient NTRK3 nucleic acid sequence such that the encoded NTRK3fusion polypeptide has a kinase activity, e.g., has an elevated activity, e.g., an NTRK3 kinase activity, e.g., a TRKC kinase activity, as compared with wildtype NTRK3, e.g., in a cell of a cancer referred to herein. In certain embodiments, the NTRK3 fusion comprises at least one encoded exon (or a fragment thereof) shown in the "Last exon of 5' transcript" column of Table M and at least one encoded exon (or a fragment thereof) shown in the "First exon of 3' transcript" column of Table M. In certain embodiments, the NTRK3 fusion comprises the rearrangement shown in Table O. In certain embodiments, the NTRK3 fusion comprises the exons shown in "Rearrangement" column of Table O.

In some embodiments, the nucleic acid molecule includes a nucleotide sequence that includes a breakpoint. For example, the nucleic acid molecule includes a nucleotide sequence that includes the fusion junction between a gene of Table K and the NTRK3 gene, e.g., Breakpoint 1 and/or Breakpoint 2 of Table O.

In one embodiment, the nucleic acid molecule is complementary to at least a portion of a nucleotide sequence disclosed herein, e.g., is capable of hybridizing under a stringency condition described herein to one or more of SEQ ID NO: 9 or SEQ ID NO: 192, or a nucleotide sequence of Tables K or M (e.g., any one of SEQ ID NOs: 7 or 130-149 or 11 or 168-176) or a fragment thereof of any of the foregoing. In yet other embodiments, the nucleic acid molecule hybridizes to a nucleotide sequence that is complementary to at least a portion of a nucleotide sequence disclosed herein, e.g., is capable of hybridizing under a stringency condition described herein to a nucleotide sequence complementary to one or more of SEQ ID NO: 9 or SEQ ID NO: 192, or a nucleotide sequence of Tables K or M (e.g., any one of SEQ ID NOs: 7 or 130-149 or 11 or 168-176) or a fragment thereof of any of the foregoing.

In another embodiment, the NTRK3 fusion nucleic acid comprises any of at least 6, at least 12, at least 15, at least 20, at least 25, at least 50, at least 75, at least 100, or more nucleotides from one or more exons of a nucleotide sequence provided in Table K (e.g., any one of SEQ ID NOs: 7 or 130-149; or any Transcript ID provided in Table K), and any of at least 6, at least 12, at least 15, at least 20, at least 25, at least 50, at least 75, at least 100, or more nucleotides from one or more exons NTRK3 (e.g., of the NTRK3 sequence shown in FIG. 10 (SEQ ID NO: 9), or in FIG. 38A (SEQ ID NO: 192)).

In other embodiments, the nucleic acid molecule includes a nucleotide sequence encoding an NTRK3 fusion polypeptide that includes a fragment of a gene of Table K and a fragment of an NTRK3 gene. In one embodiment, the nucleotide sequence encodes an NTRK3 fusion polypeptide that includes e.g., an NTRK3 tyrosine kinase domain or a functional fragment thereof, e.g., a TRKC kinase domain. In yet other embodiments, the nucleic acid molecule includes a nucleotide sequence encoding the amino acid sequence (e.g., a fragment of the amino acid sequence) provided in Table L (e.g., any one of SEQ ID NOs: 8 or 150-167) and a nucleotide sequence encoding the amino acid sequence (e.g., a fragment of the amino acid sequence) shown in FIG. 11 (e.g., SEQ ID NO: 10) or in FIG. 38B (SEQ ID NO: 193), or a fragment of thereof, or a sequence substantially identical thereto. In yet other embodiments, the nucleic acid includes a nucleotide sequence encoding an amino acid sequence provided in Table N (e.g., any one of SEQ ID NOs: 12 or 177-185), or a fragment thereof (or a sequence substantially identical thereto). In one embodiment, the encoded NTRK3 fusion polypeptide includes an NTRK3 tyrosine kinase domain, e.g., a TRKC kinase domain, e.g., one or more of exons 15-19 of SEQ ID NO: 9 or of any one of SEQ ID NOs: 192-193, or a functional fragment thereof.

In a related aspect, the disclosure features nucleic acid constructs that include the NTRK3 fusion nucleic acid molecules described herein. In certain embodiments, the nucleic acid molecules are operatively linked to a native or a heterologous regulatory sequence. Also included are vectors and host cells that include the NTRK3 nucleic acid molecules described herein, e.g., vectors and host cells suitable for producing the nucleic acid molecules and polypeptides described herein.

In a related aspect, methods of producing the nucleic acid molecules and polypeptides described herein are also described.

In another aspect, the disclosure features nucleic acid molecules that reduce or inhibit the expression of a nucleic acid molecule that encodes an NTRK3 fusion molecule described herein. Examples of such nucleic acid molecules include, for example, antisense molecules, ribozymes, RNAi, or triple helix molecules that hybridize to a nucleic acid encoding an NTRK3 fusion polypeptide, or a transcription regulatory region of an NTRK3 fusion nucleic acid molecule, and block or reduce mRNA expression of an NTRK3 fusion nucleic acid molecule.

Detection of NTRK3 Fusion Nucleic Acid Molecules

The disclosure also features a nucleic acid molecule (e.g., nucleic acid fragment, suitable as a probe, primer, bait, or a library member, that includes, flanks, or hybridizes to) which is useful for identifying, or is otherwise based on, an NTRK3 fusion described herein. In certain embodiments, the probe, primer bait, or library member is an oligonucleotide that allows capture, detection, or isolation of an NTRK3 fusion nucleic acid molecule described herein. The oligonucleotide can comprise a nucleotide sequence substantially complementary to a fragment of the NTRK3 fusion nucleic acid molecules described herein. The sequence identity between the nucleic acid fragment, e.g., the oligonucleotide, and the target NTRK3 sequence need not be exact, so long as the sequences are sufficiently complementary to allow the capture, detection or isolation of the target sequence. In one embodiment, the nucleic acid fragment is a probe or primer that includes between about 5 and 25, e.g., between 10 and 20, or 10 and 15 nucleotides. In other embodiments, the nucleic acid fragment is a bait that includes between about 100 nucleotides to about 300 nucleotides, between about 130 nucleotides to about 230 nucleotides, or between about 150 nucleotides to about 200 nucleotides.

In one embodiment, the nucleic acid fragment can be used to identify or capture, e.g., by hybridization, an NTRK3 fusion. For example, the nucleic acid fragment can be a probe, a primer, or a bait, for use in identifying or capturing, e.g., by hybridization, an NTRK3 fusion molecule described herein. In one embodiment, the nucleic acid fragment can be useful for identifying or capturing a breakpoint associated with an NTRK3 fusion nucleic acid molecule described herein, e.g., a nucleotide sequence comprise Breakpoint 1 and/or Breakpoint 2 provided in Table O, or a rearrangement provided in Table O.

In one embodiment, the nucleic acid fragment hybridizes to a nucleotide sequence within a Breakpoint 1 and/or Breakpoint 2 provided in Table O or a chromosomal rearrangement provided in Table O. For example, the nucleic acid fragment can hybridize to a nucleotide sequence that includes the fusion junction between the a gene provided in Table K and the NTRK3 gene, e.g., a nucleotide sequence that includes a portion of a nucleotide sequence of a gene in Table K (e.g., any one of SEQ ID NOs: 7 or 130-149; or any Transcript ID provided in Table K) and a portion of an NTRK3 gene.

In another embodiment, the nucleic acid fragment hybridizes to a nucleotide sequence that comprises any of at least 6, at least 12, at least 15, at least 20, at least 25, at least 50, at least 75, at least 100, at least 150, or more nucleotides from an exon provided in the "Last exon of 5' transcript" column of Table M and any of at least 6, at least 12, at least 15, at least 20, at least 25, at least 50, at least 75, at least 100, at least 150, or more nucleotides from an exon provided in the "First exon of 3' transcript" column of Table M.

The probes or primers described herein can be used, for example, for FISH detection or PCR amplification. In one exemplary embodiment where detection is based on PCR, amplification of an NTRK3 fusion junction provided herein (e.g., a Breakpoint 1 and/or Breakpoint 1 provided in Table M or a rearrangement provided in Table M) can be performed using a primer or a primer pair, e.g., for amplifying a sequence flanking the fusion junctions described herein, e.g., the junction of a chromosomal rearrangement described herein, e.g., a Breakpoint 1 and/or Breakpoint 1 provided in Table M or a rearrangement provided in Table M.

In one embodiment, a pair of isolated oligonucleotide primers can amplify a region containing or adjacent to a position in the NTRK3 fusion. For example, forward primers can be designed to hybridize to a nucleotide sequence within the genomic sequence or mRNA sequence of a gene of Table K (e.g., a nucleotide sequence within an exon of a sequence provided in Table K, e.g., any one of SEQ ID NOs: 7 or 130-149), and the reverse primers can be designed to hybridize to a nucleotide sequence of NTRK3 (e.g., a nucleotide sequence within an exon NTRK3 of SEQ ID NO: 9 or SEQ ID NO: 192).

In another embodiment, the nucleic acid fragments can be used to identify, e.g., by hybridization, an NTRK3 fusion molecule. In one embodiment, the nucleic acid fragment hybridizes to a nucleotide sequence that includes a fusion junction between a gene of Table K and the NTRK3 gene.

In certain embodiments, the nucleic acid fragments are used in a FISH assay. In one embodiment, the FISH assay is a break-apart FISH assay. In one embodiment, at least two nucleic acid fragments (e.g., probes) hybridize to (e.g., are complementary to) at least two preselected nucleotide sequences of the NTRK3 fusion molecule, such that a change in (e.g., the presence or absence of) a signal associated with the nucleic acid fragments, e.g., a fluorescent signal, is indicative of the presence or absence of the NTRK3 fusion molecule or an intact NTRK3 or a gene of Table K. Typically, the nucleic acid fragments are associated with a label or signal, e.g., a covalently or non-covalently associated signal or label chosen from, e.g., a radiolabel, a fluorescent label, a bioluminescent label, a chemiluminescent label, an enzyme label, a binding pair label, or an affinity tag.

In some exemplary embodiments, at least one first nucleic acid fragment (e.g., probe) hybridizes to a gene of Table K (e.g., a nucleotide sequence within an exon of a sequence provided in Table K, e.g., any one of SEQ ID NOs: 7 or 130-149), and at least one second nucleic acid fragment (e.g., probe) hybridizes to a nucleotide sequence of NTRK3 (e.g., a nucleotide sequence within an exon of NTRK3 of SEQ ID NO: 9 or SEQ ID NO: 192). The first and second fragments can be associated with a detectable label or signal, e.g., a fluorescent signal, such that a different signal is detected when the first and second nucleic acid fragments are in close proximity when an NTRK3 fusion nucleotide sequence is present, compared to an NTRK3 nucleotide sequence or a nucleotide sequence of a gene of Table K (e.g., an intact, full length NTRK3 nucleotide sequence or an intact, full length nucleotide sequence of a gene in Table K).

In other embodiments, the nucleic acid fragment includes a bait that comprises a nucleotide sequence that hybridizes to an NTRK3 fusion nucleic acid molecule described herein, and thereby allows the capture or isolation of said nucleic acid molecule. In one embodiment, a bait is suitable for solution phase hybridization. In other embodiments, a bait includes a binding entity, e.g., an affinity tag, that allows capture and separation, e.g., by binding to a binding entity, of a hybrid formed by a bait and a nucleic acid hybridized to the bait.

In other embodiments, the nucleic acid fragment includes a library member comprising an NTRK3 nucleic acid molecule described herein. In one embodiment, the library member includes a rearrangement that results in an NTRK3 fusion molecule described herein.

The nucleic acid fragment can be detectably labeled with, e.g., a radiolabel, a fluorescent label, a bioluminescent label, a chemiluminescent label, an enzyme label, a binding pair label, or can include an affinity tag, a tag, or identifier (e.g., an adaptor, barcode, or other sequence identifier).

NTRK3 Fusion Polypeptides

In another embodiment, the NTRK3 fusion polypeptide comprises an amino acid sequence (e.g., a fragment of the amino acid sequence) provided in Table L (e.g., any one of SEQ ID NOs: 8 or 150-167) and an amino acid sequence (e.g., a fragment of the amino acid sequence) shown in FIG. 11 (SEQ ID NO: 10) or in FIG. 38B (SEQ ID NO: 193). In one embodiment, the NTRK3 fusion polypeptide comprises an amino acid sequence substantially identical to an amino acid sequence (e.g., a fragment of the amino acid sequence) provided in Table L (e.g., any one of SEQ ID NOs: 8 or 150-167) and the amino acid sequence (e.g., a fragment of the amino acid sequence) shown in FIG. 11 (SEQ ID NO: 10), or in FIG. 38B (SEQ ID NO: 193), or a fragment thereof. In one embodiment, the NTRK3 fusion polypeptide comprises an amino acid sequence at least 70%, 75%, 80%, 85%, 90%, 91%, 92%, 93%, 94%, 95%, 96%, 97%, 98%, 99%, or 99.5% identical to an amino acid sequence (e.g., a fragment of the amino acid sequence) provided in Table L (e.g., any one of SEQ ID NOs: 8 or 150-167) and the amino acid sequence (e.g., a fragment of the amino acid sequence) shown in FIG. 11 (SEQ ID NO: 10) or in FIG. 38B (SEQ ID NO: 193).

In one embodiment, the NTRK3 fusion polypeptide comprises a sequence containing any of at least about 10, at least about 20, at least about 50, at least about 100, at least about 500, at least about 600, at least about 700, at least about 800, at least about 900, at least about 1000, or more amino acids of an amino acid sequence provided in Table L (e.g., any one of SEQ ID NOs: 8 or 150-167) and of the amino acid sequence provided in FIG. 11 (SEQ ID NO: 10) or in FIG. 38B (SEQ ID NO: 193) in combination. In one embodiment, the NTRK3 fusion polypeptide comprises an amino acid sequence containing any of at least about 5, at least about 10, at least about 20, at least about 50, at least about 100, at least about 500, or more amino acids (e.g., contiguous amino acids) of an amino acid sequence provided in Table L (e.g., any one of SEQ ID NOs: 8 or 150-167) and any of at least about 5, at least about 10, at least about 20, at least about 50, at least about 100, at least about 500, or more amino acids (e.g., contiguous amino acids) of the amino acid sequence shown in FIG. 11 (SEQ ID NO: 10) or in FIG. 38B (SEQ ID NO: 193).

In one embodiment, the NTRK3 fusion polypeptide includes an NTRK3 receptor tyrosine kinase domain (e.g., a TRKC kinase domain) or a functional fragment thereof. In an embodiment, the NTRK3 fusion polypeptide comprises sufficient NTRK3 sequence and sufficient sequence of a polypeptide comprising an amino acid sequence provided in Table L (e.g., any one of SEQ ID NOs: 8 or 150-167) such that it has a kinase activity, e.g., has an elevated activity, e.g., an NTRK3 kinase activity, e.g., a TRKC kinase activity, as compared with wildtype NTRK3, e.g., in a cell of a cancer described herein (e.g., a cancer provided in Table O).

In yet other embodiments, the NTRK3 fusion polypeptide comprises an amino acid sequence provided in Table N (e.g., any one of SEQ ID NOs: 12 or 177-185), or an amino acid sequence substantially identical thereto (e.g., at least 70%, 75%, 80%, 85%, 90%, 91%, 92%, 93%, 94%, 95%, 96%, 97%, 98%, 99%, or 99.5% identical to the amino acid sequence, or a fragment of the amino acid sequence).

In another aspect, the disclosure provides an NTRK3 fusion polypeptide (e.g., a purified NTRK3 fusion polypeptide), a biologically active or antigenic fragment thereof, as well as reagents (e.g., antibody molecules that bind to an NTRK3 fusion polypeptide), methods for modulating an NTRK3 polypeptide activity, and detection of an NTRK3 polypeptide.

In one embodiment, the NTRK3 fusion polypeptide has at least one biological activity, e.g., an NTRK3 kinase activity (e.g., a TRKC kinase activity). In one embodiment, at least one biological activity of the NTRK3 fusion polypeptide is reduced or inhibited by an anti-cancer drug, e.g., a kinase inhibitor (e.g., a multikinase inhibitor, an NTRK-specific kinase inhibitor, or an NTRK3-specific inhibitor). Exemplary multikinase inhibitors include, e.g., KRC-108, crizotinib, and K252a. In one embodiment, at least one biological activity of the NTRK3 fusion polypeptide is reduced or inhibited by an NTRK kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928. In certain embodiments, the NTRK kinase inhibitor is larotrectinib.

In yet other embodiments, the NTRK3 fusion polypeptide is encoded by a nucleic acid molecule described herein. In one embodiment, the NTRK3 fusion polypeptide is encoded by a nucleic acid comprising an in-frame fusion of an exon provided in the "Last exon of 5' transcript" column of Table M with an exon provided in the "First exon of 3' transcript" column of Table M. In another embodiment, the NTRK3 fusion polypeptide comprises an amino acid sequence encoded by a nucleotide sequence comprising a fusion junction between a transcript provided in Table K (e.g., any one of SEQ ID NOs: 7 or 130-149, or any of Transcript ID provided in Table K, and the NTRK3 transcript.

In certain embodiments, the NTRK3 fusion polypeptide comprises at least one encoded exon from a gene provided in Table K (e.g., any one of SEQ ID NOs: 7 or 130-149; or any Transcript ID provided in Table K) and at least one exon of NTRK3. In certain embodiments, the NTRK3 fusion polypeptide is encoded by a nucleic acid molecule comprising Breakpoint 1 and/or Breakpoint 2 provided in Table O. In certain embodiments, the NTRK3 fusion polypeptide is encoded by a nucleic acid molecule comprising a rearrangement provided in Table O In certain embodiments, the NTRK3 fusion comprises the amino acid sequence corresponding to at least one exon or a fragment thereof from a gene provided in Table K (e.g., any one of SEQ ID NOs: 7 or 130-149; or any Transcript IDs provided in Table K), and the amino acid sequence corresponding to at least one exon or a fragment thereof from NTRK3 (e.g., as shown in FIG. 11 (SEQ ID NO: 10) or in FIG. 38B (SEQ ID NO: 193)). In one embodiment, the NTRK3 fusion comprises any of at least 5, at least 10, at least 15, at least 20, or more amino acids from an exon of a gene of Table L (e.g., any one of SEQ ID NOs: 8 or 150-167), and any of at least 5, at least 10, at least 15, at least 20, or more amino acids from an exon of NTRK3 (e.g., from the amino acid sequence of NTRK3, e.g., of the NTRK3 sequence shown in FIG. 11 (SEQ ID NO: 10) or in FIG. 38B (SEQ ID NO: 193)).

In one embodiment, the NTRK3 fusion polypeptide includes an NTRK3 tyrosine kinase domain (e.g., a TRKC kinase domain) or a functional fragment thereof. In a related aspect, the disclosure provides NTRK3 fusion polypeptides or fragments operatively linked to heterologous polypeptides to form fusion proteins.

In another embodiment, the NTRK3 fusion polypeptide or fragment is a peptide, e.g., an immunogenic peptide or protein that contains a fusion junction described herein. Such immunogenic peptides or proteins can be used to raise antibodies specific to a fusion protein. In other embodiments, such immunogenic peptides or proteins can be used for vaccine preparation.

The vaccine preparation can include other components, e.g., an adjuvant.

In another aspect, the disclosure features antibody molecules that bind to an NTRK3 fusion polypeptide or fragment described herein. In some embodiments, the antibody can distinguish wildtype NTRK3 or a wild type protein provided in Table L (e.g., a wild type protein comprising the amino acid sequence of any one of SEQ ID NOs: 8 or 150-167) from an NTRK3 fusion polypeptide described herein.

Methods of Treating and or Reducing Fusion Molecule Activity

In another aspect, the disclosure features a method of reducing an activity of a fusion molecule described herein. The method includes contacting the fusion molecule, or a fusion molecule-expressing cell, with an agent that inhibits an activity or expression of the fusion molecule (e.g., an inhibitor, e.g., a kinase inhibitor). In one embodiment, the contacting step can be effected in vitro, e.g., in a cell lysate or in a reconstituted system. Alternatively, the method can be performed on cells in culture, e.g., in vitro or ex vivo. In other embodiments, the method can be performed on fusion molecule-expressing cells present in a subject, e.g., as part of an in vivo (e.g., therapeutic or prophylactic) protocol. In an embodiment, the method is practiced on an animal subject (e.g., an in vivo animal model). In certain embodiments, the fusion molecule is a fusion nucleic acid molecule, or a fusion polypeptide, as described herein.

In a related aspect, a method of inhibiting, reducing, or treating a hyperproliferative disorder, e.g., a neoplasm (including benign, pre-malignant or malignant (e.g., a cancer)), in a subject is provided. The method includes administering to the subject a therapeutic agent, e.g., an anti-cancer agent (e.g., an inhibitor, e.g., a kinase inhibitor as described herein), as a single agent, or in combination, in an amount sufficient to reduce, inhibit or treat the activity or expression of one or more fusion molecules described herein (e.g., a fusion nucleic acid molecule provided herein, e.g., in Tables C, H, or M, or a fusion polypeptide provided herein e.g., in Tables D, I, or N), thereby inhibiting, reducing, or treating the hyperproliferative disorder in the subject.

In a related aspect, a method of inhibiting, reducing, or treating a hyperproliferative disorder, e.g., a neoplasm (including benign, pre-malignant or malignant (e.g., a cancer)), in a subject is provided. The method includes administering to the subject a therapeutic agent, e.g., an anti-cancer agent (e.g., an inhibitor, e.g., a kinase inhibitor as described herein), as a single agent, or in combination, in an amount sufficient to reduce, inhibit or treat the activity or expression of one or both of MEX3A-NTRK1 (e.g., a MEX3A-NTRK1 fusion molecule described herein) or CARM1-NTRK3 (e.g., a CARM1-NTRK3 fusion molecule described herein), thereby inhibiting, reducing, or treating the hyperproliferative disorder in the subject.

"Treatment" as used herein includes, but is not limited to, inhibiting tumor growth, reducing tumor mass, reducing size or number of metastatic lesions, inhibiting the development of new metastatic lesions, prolonged survival, prolonged progression-free survival, prolonged time to progression, and/or enhanced quality of life.

In one embodiment, the subject is a mammal, e.g., a human. In one embodiment, the subject has, or is at risk of having a cancer at any stage of disease. In other embodiments, the subject is a patient, e.g., a cancer patient. In one embodiment, the subject treated has a MEX3A-NTRK1 fusion; e.g., the subject has a tumor or cancer harboring a MEX3A-NTRK1 fusion. In other embodiments, the subject has been previously identified as having a MEX3A-NTRK1 fusion. In some embodiments, the subject treated has a fusion molecule described herein (e.g., a fusion nucleic acid molecule provided herein, e.g., in Tables C, H, or M, or a fusion polypeptide provided herein e.g., in Tables D, I, or N). In other embodiments, the subject has been previously identified as having a fusion molecule described herein (e.g., a fusion nucleic acid molecule provided herein, e.g., in Tables C, H, or M, or a fusion polypeptide provided herein e.g., in Tables D, I, or N).

In one embodiment, the subject treated has a CARM1-NTRK3 fusion; e.g., the subject has a tumor or cancer harboring a CARM1-NTRK3 fusion. In other embodiments, the subject has been previously identified as having a CARM1-NTRK3 fusion.

In some embodiments, the subject treated has a fusion molecule described herein (e.g., a fusion nucleic acid molecule provided herein, e.g., in Tables C, H, or M, or a fusion polypeptide provided herein e.g., in Tables D, I, or N); e.g., the subject has a tumor or cancer harboring a fusion molecule described herein (e.g., a fusion nucleic acid molecule provided herein, e.g., in Tables C, H, or M, or a fusion polypeptide provided herein e.g., in Tables D, I, or N). In other embodiments, the subject has been previously identified as having a fusion molecule described herein (e.g., a fusion nucleic acid molecule provided herein, e.g., in Tables C, H, or M, or a fusion polypeptide provided herein e.g., in Tables D, I, or N).

In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of one or both of a MEX3A-NTRK1 fusion or a CARM1-NTRK3 fusion. In some embodiments, the subject has been previously identified as being likely or unlikely to respond to treatment with a protein kinase inhibitor, based on the presence of one or more of a fusion molecule described herein (e.g., a fusion nucleic acid molecule provided herein, e.g., in Tables C, H, or M, or a fusion polypeptide provided herein e.g., in Tables D, I, or N).

In one embodiment, the inhibitor, e.g., the kinase inhibitor, is administered based on a determination that a fusion molecule described herein (e.g., one or both of a MEX3A-NTRK1 fusion or a CARM1-NTRK3 fusion, and/or one or more of a fusion nucleic acid molecule provided herein, e.g., in Tables C, H, or M, or a fusion polypeptide provided herein e.g., in Tables D, I, or N) is present in a subject, e.g., based on its presence in a subject's sample. Thus, treatment can be combined with fusion molecule detection or evaluation method, e.g., as described herein, or administered in response to a determination made by a fusion molecule detection or evaluation method, e.g., as described herein. In certain embodiments, the kinase inhibitor is administered responsive to acquiring knowledge or information of the presence of the fusion molecule in a subject. In one embodiment, the kinase inhibitor is administered responsive to acquiring knowledge or information on the subject's genotype, e.g., acquiring knowledge or information that the patient's genotype has a fusion molecule. In other embodiments, the kinase inhibitor is administered responsive to receiving a communication (e.g., a report) of the presence of the fusion molecule in a subject (e.g., a subject's sample). In yet other embodiments, the kinase inhibitor is administered responsive to information obtained from a collaboration with another party that identifies the presence of the fusion molecule in a subject (e.g., a subject's sample). In other embodiments, the kinase inhibitor is administered responsive to a determination that the fusion molecule is present in a subject. In one embodiment, the determination of the presence of the fusion molecule is carried out using one or more of the methods, e.g., the sequencing methods, described herein. In other embodiments, the determination of the presence of the fusion molecule includes receiving information on the subject's fusion molecule genotype, e.g., from another party or source.

The methods can, optionally, further include the step(s) of identifying (e.g., evaluating, diagnosing, screening, and/or selecting) a subject at risk of having, or having, a fusion molecule described herein. In one embodiment, the method further includes one or more of: acquiring knowledge or information of the presence of the fusion molecule in a subject (e.g., a subject's sample); acquiring knowledge or information on the subject's genotype, e.g., acquiring knowledge or information that the patient's genotype has a fusion molecule; receiving a communication (e.g., a report) of the presence of the fusion molecule in a subject (e.g., a subject's sample); or collaborating with another party that identifies the presence of the fusion molecule in a subject.

In one embodiment, the subject treated has a fusion molecule described herein (e.g., a fusion nucleic acid molecule provided herein or a fusion polypeptide provided herein); e.g., the subject has a tumor or cancer harboring a fusion molecule described herein. In other embodiments, the subject has been previously identified as having a fusion molecule described herein. In yet other embodiments, the subject has been previously identified as being likely or unlikely to respond to treatment with a protein kinase inhibitor, e.g., a subject that has previously participated in a clinical trial. In other embodiments, the subject has been previously identified as being likely or unlikely to respond to treatment with a protein kinase inhibitor, based on the presence of a fusion molecule described herein. In one embodiment, the subject is a mammal, e.g., a human. In one embodiment, the subject has, or is at risk of having a cancer at any stage of disease. In other embodiments, the subject is a patient, e.g., a cancer patient.

In other embodiments, the subject treated is a cancer patient who has participated in a clinical trial. For example, the subject participated in a clinical trial that evaluated a kinase inhibitor (e.g., a multikinase inhibitor or a specific kinase inhibitor). In other embodiments, the subject participated in a clinical trial that evaluates upstream or downstream targets of the specific kinase. In one embodiment, said cancer patient responded to the evaluated kinase inhibitor.

In certain embodiments, the neoplasm or neoplastic cell is a benign, pre-malignant, malignant (cancer), or metastasis. In certain embodiments, the cancer is a solid tumor, a soft tissue tumor, or a metastatic lesion. In one embodiment, the cancer is chosen from ovarian carcinosarcoma, vaginal melanoma, salivary gland mammary analogue secretory carcinoma, soft tissue fibrosarcoma, a salivary gland tumor, histiocytosis, a thyroid tumor, a soft tissue sarcoma, or chondrosarcoma. In one embodiment, the cancer is chosen from ovarian carcinosarcoma or vaginal melanoma. In one embodiment, the cancer is ovarian carcinosarcoma. In another embodiment, the cancer is an ovarian cancer (e.g., an ovarian carcinosarcoma) that has an alteration in NTRK1, e.g., has a MEX3A-NTRK1 molecule described herein. In one embodiment, the cancer is vaginal melanoma. In another embodiment, the cancer is a melanoma (e.g., a vaginal melanoma) that has an alteration in NTRK3, e.g., has a CARM1-NTRK3 molecule described herein.

In one embodiment, the cancer is chosen from lung adenocarcinoma, cervical adenocarcinoma, uterus endometrial adenocarcinoma, glioblastoma, melanoma, spindle cell sarcoma, ameloblastic fibroscarcoma, adenocarcinoma, cholangiocarcinoma, urothelial (transitional cell) carcinoma, ovarian epithelial carcinoma, colorectal adenocarcinoma, breast carcinoma, prostate carcinoma, or pancreas ductal adenocarcinoma. In one embodiment, the cancer is chosen from a lung cancer, a pancreatic cancer, melanoma, a colorectal cancer, an esophageal-gastric cancer, a thyroid cancer, or an adenocarcinoma.

In some embodiments, the cancer is selected from an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, and a brain medulloblastoma. In some embodiments, the cancer is a colorectal cancer, and the colorectal cancer comprises high microsatellite instability. In some embodiments, the cancer comprises a tumor mutation burden of 20 mut/mB or more. In some embodiments, the cancer does not have an alteration in one or more of ALK, BRAF, ERBB2, EGFR, ROS1, or KRAS. In some embodiments, the cancer has no detectable altered level or activity in one or more of EGFR, KRAS, ALK, ROS1 or RET. In some embodiments, the cancer has an NTRK1 fusion molecule described herein, e.g., an NTRK1 fusion nucleic acid molecule and/or an NTRK1 fusion polypeptide described herein.

In some embodiments, the cancer is selected from a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, and a colon adenocarcinoma. In some embodiments, the cancer is a colorectal cancer, and the colorectal cancer comprises high microsatellite instability. In some embodiments, the cancer comprises a tumor mutation burden of 20 mut/mB or more. In some embodiments, the cancer does not have an alteration in one or more of ALK, BRAF, ERBB2, EGFR, ROS1, or KRAS. In some embodiments, the cancer has no detectable altered level or activity in one or more of EGFR, KRAS, ALK, ROS1 or RET. In some embodiments, the cancer has an NTRK2 fusion molecule described herein, e.g., an NTRK2 fusion nucleic acid molecule and/or an NTRK2 fusion polypeptide described herein.

In some embodiments, the cancer is selected from a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma. In some embodiments, the cancer comprises a tumor mutation burden of 20 mut/mB or more. In some embodiments, the cancer does not have an alteration in one or more of ALK, BRAF, ERBB2, EGFR, ROS1, or KRAS. In some embodiments, the cancer has no detectable altered level or activity in one or more of EGFR, KRAS, ALK, ROS1 or RET. In some embodiments, the cancer has an NTRK3 fusion molecule described herein, e.g., an NTRK1 fusion nucleic acid molecule and/or an NTRK3 fusion polypeptide described herein.

In other embodiment, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, a lung carcinoid tumor, large cell carcinoma, a lung neuroendocrine tumor, or a combination thereof. In one embodiment, the lung cancer is NSCLC or SCC. In another embodiment, the cancer is a lung cancer (e.g., lung adenocarcinoma) that has an alteration in NTRK1, e.g., has a MEX3A-NTRK1 molecule described herein. In another embodiment, the cancer is a lung cancer (e.g., lung adenocarcinoma) that has no detectable altered level or activity in one or more of EGFR, KRAS, ALK, ROS1 or RET. In another embodiment, the cancer is melanoma (e.g., a vaginal melanoma) that has an alteration in NTRK3, e.g., has a CARM1-NTRK3 molecule described herein.

In some embodiments, the cancer is a solid tumor.

In one embodiment, the anti-cancer agent or inhibitor is a kinase inhibitor. For example, the kinase inhibitor is a multi-kinase inhibitor (e.g., KRC-108 or K252a) or an NTRK-specific inhibitor. In one embodiment, the kinase inhibitor is an NTRK1-inhibitor, an NTRK2-inhibitor, and/or an NTRK3-inhibitor, including, but not limited to, AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo [1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928. In some embodiments, the kinase inhibitor is larotrectinib, AZ-23, danusertib (PHA-739358), entrectinib, lestaurtinib (CEP-701), AZD7451, belizatinib, selitrectinib, or crizotinib. In some embodiments, the kinase inhibitor is larotrectinib. In some embodiments, the kinase inhibitor is entrectinib.

In other embodiments, the anti-cancer agent or inhibitor is an HSP90 inhibitor. Previous studies have shown that the HSP90 inhibitor 17-DMAG disrupted Ntrk1/Hsp90 binding, which results in degradation and depletion of Ntrk1, and reduced the growth of myeloid leukemia cells (Rao R, Nalluri S, Fiskus W, et al. (2010) *Mol Cancer Ther* 9(8): 2232-42). In one embodiment, the HSP90 inhibitor is a geldanamycin derivative, e.g., a benzoquinone or hygroquinone ansamycin HSP90 inhibitor. For example, the HSP90 inhibitor can be chosen from one or more of 17-AAG (also known as tanespimycin or CNF-1010), 17-DMAG, BIIB-021 (CNF-2024), BIIB-028, AUY-922 (also known as VER-49009), SNX-5422, STA-9090, AT-13387, XL-888, MPC-3100, CU-0305, CNF-1010, Macbecin I, Macbecin II, CCT-018159, CCT-129397, IPI-493, IPI-504, PU-H71, or PF-04928473 (SNX-2112).

In other embodiments, the anti-cancer agent or inhibitor is an antagonist of a fusion molecule described herein which inhibits the expression of a nucleic acid encoding the fusion molecule. Examples of such fusion molecule antagonists include nucleic acid molecules, for example, antisense molecules, ribozymes, RNAi, triple helix molecules that hybridize to a nucleic acid encoding a fusion molecule described herein, or a transcription regulatory region, and block or reduce mRNA expression of the fusion molecule.

In other embodiments, the anti-cancer agent or inhibitor, e.g., kinase inhibitor, is administered in combination with a second therapeutic agent or a different therapeutic modality, e.g., anti-cancer agents, and/or in combination with surgical and/or radiation procedures. For example, the second therapeutic agent can be a cytotoxic or a cytostatic agent. Exemplary cytotoxic agents include antimicrotubule agents, topoisomerase inhibitors, or taxanes, antimetabolites, mitotic inhibitors, alkylating agents, intercalating agents, agents capable of interfering with a signal transduction pathway, agents that promote apoptosis and/or radiation. In yet other embodiments, the methods can be used in combination with immunodulatory agents, e.g., IL-1, 2, 4, 6, or 12, or interferon alpha or gamma, or immune cell growth factors such as GM-CSF.

In one embodiment, the kinase inhibitor (e.g., the multi-kinase inhibitor or the NTRK-specific inhibitor as described herein) is administered in combination with an HSP90 inhibitor, e.g., an HSP90 inhibitor as described herein.

Unless otherwise defined, all technical and scientific terms used herein have the same meaning as commonly understood by one of ordinary skill in the art to which this disclosure belongs. Although methods and materials similar or equivalent to those described herein can be used in the practice or testing of the disclosure, suitable methods and materials are described below. All publications, patent applications, patents, and other references mentioned herein are incorporated by reference in their entirety. In case of conflict, the present specification, including definitions, will control. In addition, the materials, methods, and the example are illustrative only and not intended to be limiting.

The details of one or more embodiments featured in the disclosure are set forth in the accompanying drawings and the description below. Other features, objects, and advantages featured in the disclosure will be apparent from the description and drawings, and from the claims.

BRIEF DESCRIPTION OF THE DRAWINGS

FIGS. 1A-1C are tables summarizing the fusion molecules and the rearrangement events described herein.

FIG. 1A summarizes the following: the name of the fusion (referred to as “fusion”); the tissue source (referred to as “Cancer type”); the approximate locations of the first and second breakpoints that give rise to the rearrangement events (+50 nucleotides) (referred to as “Breakpoint 1” and “Breakpoint 2,” respectively); and the type of rearrangement (referred to as “Rearrangement”).

FIG. 1B summarizes the following: the name of the fusion (referred to as “fusion”); the accession number of the full length sequences that contain the 5'- and the 3'-exon sequences (referred to as “5' Transcript ID” and “3' Transcript ID,” respectively); and the identity of the last exon of the 5' transcript and the first exon of the 3' transcript. The sequences corresponding to the accession numbers provided in FIG. 1B are set forth in the figures appended herein. Alternatively, the sequences can be found by searching for the Accession Number in the GenBank database of NIH. For example, the following link can be used: www.ncbi.nlm-.nih.gov/nuccore/NM_002529.3 to search for Accession Number=NM_002529.3.

FIG. 1C summarizes the following: the name of the fusion; the SEQ ID NOs. of the nucleotide (Nt) and amino acid (Aa) sequences of the fusion (if shown), the 5' partner, and the 3' partner; and the figure in which the sequence is shown. For example, Nt and Aa sequences of MEX3A have SEQ ID NOs: 1 and 2, respectively, which are shown in FIGS. 2 and 3, respectively. The Nt and Aa sequences of NTRK1 have SEQ ID NOs: 3 and 4, which are shown in FIGS. 4 and 5, respectively.

FIG. 2 depicts the nucleotide sequence of MEX3A cDNA (NM_001093725.2, SEQ ID NO: 1). The start of the first exon is shown by a single underline. Further exons (e.g., second) are indicated consecutively from 5' to 3' orientation by the underline of two consecutive nucleotides at the start of each exon. The start codon is shown in bold and italics. The stop codon is shown in italics and underlined.

FIG. 3 depicts the amino acid sequence of MEX3A (SEQ ID NO: 2).

FIG. 4 depicts the nucleotide sequence of NTRK1 cDNA (NM_002529.3, SEQ ID NO: 3). The start of the first exon is shown by a single underline. Further exons (e.g., second, third, fourth, etc.) are indicated consecutively from 5' to 3' orientation by the underline of two consecutive nucleotides at the start of each exon. The start codon is shown in bold and italics. The stop codon is shown in italics and underlined.

FIG. 5 depicts the amino acid sequence of NTRK1 (SEQ ID NO: 4).

FIG. 6 shows the complete cDNA sequence of MEX3A-NTRK1 with sequence derived from MEX3A and NTRK1 (SEQ ID NO: 5). The NTRK1 sequence is indicated by the underlined nucleotides. The start codon is italicized.

FIG. 7 depicts the corresponding amino acid sequence of a MEX3A-NTRK1 fusion polypeptide (SEQ ID NO: 6). In this fusion, the amino acid sequence encoded by exon 1 of MEX3A is fused to the amino acid sequence encoded by exons 9-17 of NTRK1. The amino acid sequence of NTRK1 is indicated by the underlined amino acids. The de novo amino acid (L) in the MEX3A-NTRK1 fusion polypeptide is indicated in bold italics.

FIG. 8 depicts the nucleotide sequence of CARM1 cDNA (NM_199141.2, SEQ ID NO: 7). The start of the first exon is shown by a single underline. Further exons (e.g., second, third, fourth, etc.) are indicated consecutively from 5' to 3' orientation by the underline of two consecutive nucleotides at the start of each exon. The start codon is shown in bold and italics. The stop codon is shown in italics and underlined.

FIG. 9 depicts the amino acid sequence of CARM1 (SEQ ID NO: 8).

FIG. 10 depicts the nucleotide sequence of NTRK3 cDNA (NM_002530.03, SEQ ID NO: 9). The start of the first exon is shown by a single underline. Further exons (e.g., second, third, fourth, etc.) are indicated consecutively from 5' to 3' orientation by the underline of two consecutive nucleotides at the start of each exon. The start codon is shown in bold and italics. The stop codon is shown in italics and underlined.

FIG. 11 depicts the amino acid sequence of NTRK3 (SEQ ID NO: 10).

FIG. 12 shows the complete cDNA sequence of a CARM1-NTRK3 fusion with sequence derived from CARM1 and NTRK3 (SEQ ID NO: 11). The NTRK3 sequence is indicated by the underlined nucleotides. The start codon is italicized.

FIG. 13 depicts the corresponding amino acid sequence of a CARM1-NTRK3 fusion polypeptide (SEQ ID NO: 12). The amino acid sequence encoded by exons 1-3 of CARM1 is fused to the amino acid sequence encoded by exons 3-19 of NTRK3. The amino acid sequence of NTRK3 is indicated by the underlined amino acids. The de novo sequence (KQRSE) in the CARM1-NTRK3 fusion polypeptide is indicated in bold italics.

FIG. 14 depicts the nucleotide sequence flanking the MEX3A breakpoint (SEQ ID NO: 13).

FIG. 15 depicts the nucleotide sequence flanking the NTRK1 breakpoint (SEQ ID NO: 14).

FIG. 16 depicts the nucleotide sequence flanking the CARM1 breakpoint (SEQ ID NO: 15).

FIG. 17 depicts the nucleotide sequence flanking the NTRK3 breakpoint (SEQ ID NO: 16).

FIGS. 18A & 18B are tables summarizing the fusion molecules and the rearrangement events described herein.

FIG. 18A summarizes the following: the name of the fusion (referred to as “fusion”); the tissue source (referred to as “cancer type”); the approximate locations of the first and second breakpoints that give rise to the rearrangement events (+50_nucleotides) (referred to as “Breakpoint 1” and “Breakpoint 2,” respectively); and the type of rearrangement (referred to as “rearrangement”).

FIG. 18B summarizes the following: the name of the fusion (referred to as “fusion”); the accession number of the full length sequences that contain the 5'- and the 3'-exon sequences (referred to as “5' Transcript ID” and “3' Transcript ID,” respectively); and the identity of the last exon of the 5' transcript and the first exon of the 3' transcript. The sequences corresponding to the accession numbers provided in FIG. 18B are set forth herein. Alternatively, the sequences can be found by searching for the Accession Number in the GenBank database of NIH. For example, the following link can be used: www.ncbi.nlm.nih.gov/nuccore/NM_002529.3 to search for Accession Number=NM_002529.3

FIG. 19 depicts the nucleotide sequence of ADAMTSL3 (NM_207517, SEQ ID NO: 130). The first and last nucleotides in each exon are shown in bold and underlined to indicate exon boundaries. The start codon is shown in bold and italics. The stop codon is shown in italics and underlined. The sequence provided in FIG. 19 can be found by searching for the Accession Number in the GenBank database of NIH. For example, the following link can be used: www.ncbi.nlm.nih.gov/nuccore/NM_207517 to search for Accession Number=NM_207517.

FIGS. 20A-20B show nucleotide and amino acid sequences corresponding to an NTRK3-ADAMTSL3 fusion identified in soft tissue sarcoma (NOS). This fusion of NTRK3 (last exon for 5' transcript [NM_002530]: exon 14)-ADAMTSL3 (first exon of 3' transcript [NM_207517]: exon 14) resulted from an inversion rearrangement with the following breakpoints: 88576047-88576349 on chromosome 15 and 84564247-84564478 on chromosome 15. FIG. 20A shows the complete cDNA sequence of the NTRK3-ADAMTSL3 fusion (SEQ ID NO: 197). The sequence corresponding to NTRK3 is underlined. The start codon is shown in bold and underlined. The nucleotide sequence shown correlates to the exons of NTRK3 and ADAMTSL3 that are likely to be translated, however, the reading frame is not maintained between the two exons flanking the fusion junction. FIG. 20B depicts the amino acid sequence of the NTRK3-ADAMTSL3 fusion. The sequence corresponding to NTRK3 is underlined. The sequence provided depicts the part of the 5' gene that is likely to be translated and the part of the 3' gene that is likely to be translated, however the reading frame is indeterminate. The amino acid sequences of the 5' gene and of the 3' gene are separated by "I", and the fractions of codons included in the exons flanking the breakpoint are noted in brackets. Novel amino acid(s) formed by the fusion are italicized. The sequence before the "I" is provided in SEQ ID NO: 198 and the sequence after the "I" is provided in SEQ ID NO: 199. The sequences provided in FIGS. 20A-20B can be found by searching for the Accession Number in the GenBank database of NIH. For example, the following link can be used: www.ncbi.nlm-.nih.gov/nuccore/NM_002530 to search for Accession Number=NM_002530. Similarly, the following link can be used: www.ncbi.nlm.nih.gov/nuccore/NM_207517 to search for Accession Number=NM_207517.

FIGS. 21-22 show nucleotide and amino acid sequences corresponding to a PPP6R3-NTRK2 fusion identified in duodenum adenocarcinoma. This fusion of PPP6R3 (exons 1-13 NM_018312)-NTRK2 (exons 3-19 NM_006180) resulted from a Chr11:Chr9 translocation rearrangement with the following breakpoints: chr11:68341673 and chr9: 87285944. FIG. 21 shows the transcript sequence of the PPP6R3-NTRK2 fusion (SEQ ID NO: 195). FIG. 22 depicts the amino acid sequence of the PPP6R3-NTRK2 fusion (SEQ ID NO: 196). The RNA and amino acid sequences shown in FIGS. 21 and 22 are predictive, since the breakpoint, frame and splicing results were unclear. DNA data suggested an NTRK2 breakpoint in intron 2 and a PPP6R3 breakpoint in exon 13. Thus, intron 12 may be spliced out and skip exon 13 of PPP6R3. The sequences provided in FIGS. 21-22 can be found by searching for the Accession Number in the GenBank database of NIH. For example, the following link can be used: www.ncbi.nlm.nih.gov/nuccore/NM_018312 to search for Accession Number=NM_018312. Similarly, the following link can be used: www.ncbi.nlm.nih.gov/nuccore/NM_006180 to search for Accession Number=NM_006180.

FIG. 23 shows the nucleotide sequence of ACAN (NM_001135, SEQ ID NO: 132). The first and last nucleotides in each exon are shown in bold and underlined to indicate exon boundaries. The start codon is shown in bold and italics. The stop codon is shown in italics and underlined. The sequence provided in FIG. 23 can be found by searching for the Accession Number in the GenBank database of NIH. For example, the following link can be used: www.ncbi.nlm.nih.gov/nuccore/NM_001135 to search for Accession Number=NM_001135.

FIGS. 24A-24C show nucleotide and amino acid sequences corresponding to a BLM-NTRK3 fusion identified in esophagus adenocarcinoma. This fusion of BLM (last exon of 5' transcript [NM_000057]: exon 3)-NTRK3 (first exon of 3' transcript [NM_002530]: exon 14) resulted from an inversion rearrangement with the following breakpoints: 88576055-88576336 on chromosome 15 and 91294841-91295039 on chromosome 15. FIG. 24A depicts the nucleotide sequence of BLM (NM_000057, SEQ ID NO: 131). The first and last nucleotides in each exon are shown in bold and underlined to indicate exon boundaries. The start codon is shown in bold and italics. The stop codon is shown in italics and underlined. FIG. 24B shows the complete cDNA sequence of the BLM-NTRK3 fusion (SEQ ID NO: 168). The sequence corresponding to NTRK3 is underlined. The start codon is shown in bold and underlined. FIG. 24C depicts the amino acid sequence of the BLM-NTRK3 fusion (SEQ ID NO: 177). The sequence corresponding to NTRK3 is underlined. The 5' breakpoint is around the start of BLM exon 4, possibly in the exon; however, it is likely that none of exon 4 is transcribed since this would produce an in-frame fusion with no novel amino acids. Novel amino acid(s) formed by the fusion are italicized. The sequences provided in FIGS. 24A-24C can be found by searching for the Accession Number in the GenBank database of NIH. For example, the following link can be used: www.ncbi.nlm.nih.gov/nuccore/NM_000057 to search for Accession Number=NM_000057. Similarly, the following link can be used: www.ncbi.nlm.nih.gov/nuccore/NM_002530 to search for Accession Number=NM_002530.

FIG. 25 depicts the nucleotide sequence of CDK12 (NM_015083, SEQ ID NO: 135). The first and last nucleotides in each exon are shown in bold and underlined to indicate exon boundaries. The start codon is shown in bold and italics. The stop codon is shown in italics and underlined. The sequence provided in FIG. 25 can be found by searching for the Accession Number in the GenBank database of NIH. For example, the following link can be used: www.ncbi.nlm.nih.gov/nuccore/NM_015083 to search for Accession Number=NM_015083.

FIG. 26 depicts the nucleotide sequence of EFTUD1 (NM_024580, SEQ ID NO: 137). The first and last nucleotides in each exon are shown in bold and underlined to indicate exon boundaries. The start codon is shown in bold and italics. The stop codon is shown in italics and underlined. The sequence provided in FIG. 26 can be found by searching for the Accession Number in the GenBank database of NIH. For example, the following link can be used: www.ncbi.nlm.nih.gov/nuccore/NM_024580 to search for Accession Number=NM_024580.

FIG. 27 shows the nucleotide sequence of FOXB2 (NM_001013735, SEQ ID NO: 97). The first and last nucleotides in each exon are shown in bold and underlined to indicate exon boundaries. The start codon is shown in bold and italics. The stop codon is shown in italics and underlined. The sequence provided in FIG. 27 can be found by searching for the Accession Number in the GenBank database of NIH. For example, the following link can be used: www.ncbi.nlm.nih.gov/nuccore/NM_001013735 to search for Accession Number=NM_001013735.

FIGS. 28A-28C show nucleotide and amino acid sequences corresponding to an NTRK3-LRRK1 fusion identified in uterus adenosarcoma. This fusion of NTRK3 (last exon of 5' transcript [NM_002530]: exon 5)-LRRK1 (First exon of 3' transcript [NM_024652]: exon 21) resulted from an inversion rearrangement with the following breakpoints: 88726672-88726712 on chromosome 15 and 101586177-101586217 on chromosome 15. The fusion is unlikely to result in a functional polypeptide. FIG. 28A depicts the nucleotide sequence of LRRK1 (NM_024652, SEQ ID NO: 138). The first and last nucleotides in each exon are shown in bold and underlined to indicate exon boundaries. The start codon is shown in bold and italics. The stop codon is shown in italics and underlined. FIG. 28B shows the complete cDNA sequence of the NTRK3-LRRK1 fusion (SEQ ID NO: 170). The sequence corresponding to NTRK3 is underlined. The start codon is shown in bold and underlined. FIG. 28C depicts the amino acid sequence of the NTRK3-LRRK1 fusion (SEQ ID NO: 179). The sequence corresponding to NTRK3 is underlined. Novel amino acid(s) formed by the fusion are italicized. The sequences provided in FIGS. 28A-28C can be found by searching for the Accession Number in the GenBank database of NIH. For example, the following link can be used: www.ncbi.nlm.nih.gov/nuccore/NM_002530 to search for Accession Number=NM_002530. Similarly, the following link can be used: www.ncbi.nlm.nih.gov/nuccore/NM_024652 to search for Accession Number=NM_024652.

FIG. 29 shows the nucleotide sequence of MYO9 (NM_006901, SEQ ID NO: 133). The first and last nucleotides in each exon are shown in bold and underlined to indicate exon boundaries. The start codon is shown in bold and italics. The stop codon is shown in italics and underlined. The sequence provided in FIG. 29 can be found by searching for the Accession Number in the GenBank database of NIH. For example, the following link can be used: www.ncbi.nlm.nih.gov/nuccore/NM_006901 to search for Accession Number=NM_006901.

FIGS. 30A-30C show nucleotide and amino acid sequences corresponding to an NOD1-NTRK2 fusion identified in bladder urothelial (transitional cell) carcinoma. This fusion of NOD1 (last exon of 5' transcript [NM_006092]: exon 9)-NTRK2 (first exon of 3' transcript [NM_006180]: exon 8) resulted from a Chr7:9 translocation rearrangement with the following breakpoints: 87322630-87323000 on chromosome 9 and 30485058-30485317 on chromosome 7. FIG. 30A depicts the nucleotide sequence of NOD1 (NM_006092, SEQ ID NO: 99). The first and last nucleotides in each exon are shown in bold and underlined to indicate exon boundaries. The start codon is shown in bold and italics. The stop codon is shown in italics and underlined. FIG. 30B shows the complete cDNA sequence of the NOD1-NTRK2 fusion (SEQ ID NO: 118). The sequence corresponding to NTRK2 is underlined. The start codon is shown in bold and underlined. FIG. 30C depicts the amino acid sequence of the NOD1-NTRK2 fusion (SEQ ID NO: 124). The sequence corresponding to NTRK2 is underlined. Novel amino acid(s) formed by the fusion are italicized. The sequences provided in FIGS. 30A-30C can be found by searching for the Accession Number in the GenBank database of NIH. For example, the following link can be used: www.ncbi.nlm.nih.gov/nuccore/NM_006092 to search for Accession Number=NM_006092. Similarly, the following link can be used: www.ncbi.nlm.nih.gov/nuccore/NM_006180 to search for Accession Number=NM_006180.

FIGS. 31A-31B show nucleotide and amino acid sequences corresponding to a CUL4A-NTRK1 fusion identified in soft tissue sarcoma (NOS). This fusion of CUL4A (exons 1-1 NM_001008895)-NTRK1 (exons 10-17 NM_002529) resulted from a chr13:chr1 translocation rearrangement with the following breakpoints: chr13:113864171 and chr1:156844377-156844417. FIG. 31A shows the transcript sequence of the CUL4A-NTRK1 fusion (SEQ ID NO: 200). FIG. 31B shows the amino acid sequence of the CUL4A-NTRK1 fusion (SEQ ID NO: 201). The RNA and amino acid sequences shown in FIGS. 31A and 31B are predictive, since the breakpoint, frame and splicing results were unclear. DNA data suggested joining exon 1 of CUL4A to exon 3 of NTRK1 and RNA data suggested that exon 1 of CUL4A may be fused to exon 10 of NTRK1. The sequences provided in FIGS. 31A-31B can be found by searching for the Accession Number in the GenBank database of NIH. For example, the following link can be used: www.ncbi.nlm.nih.gov/nuccore/NM_001008895 to search for Accession Number=NM_001008895. Similarly, the following link can be used: www.ncbi.nlm.nih.gov/nuccore/NM_002529 to search for Accession Number=NM_002529.

FIGS. 32A-32B show nucleotide and amino acid sequences corresponding to an NOS1AP-NTRK1 fusion identified in pediatric brain glioblastoma (GBM). This fusion of NOS1AP (exons 1-10 UTR NM_014697)-NTRK1 (exons 9-17 NM_002529) resulted from a duplication rearrangement with the following breakpoints: chr1:162337088 and chr1:156843914. FIG. 32A shows the transcript sequence of the NOS1AP-NTRK1 fusion (SEQ ID NO: 202). FIG. 32B shows the amino acid sequence of the NOS1AP-NTRK1 fusion (SEQ ID NO: 203). The RNA and amino acid sequences shown in FIGS. 32A and 32B are predictive, since the breakpoint, frame and splicing results were unclear. DNA data suggested joining exon 1 of CUL4A to exon 3 of NTRK1 and RNA data suggested that exon 1 of CUL4A may be fused to exon 10 of NTRK1. DNA data suggested an NTRK1 breakpoint in intron 8 and a NOS1AP breakpoint in exon 10, 3'UTR. Exon 10 of NOS1AP may be skipped. The sequences provided in FIGS. 32A-32B can be found by searching for the Accession Number in the GenBank database of NIH. For example, the following link can be used: www.ncbi.nlm.nih.gov/nuccore/NM_014697 to search for Accession Number=NM_014697. Similarly, the following link can be used: www.ncbi.nlm.nih.gov/nuccore/NM_002529 to search for Accession Number=NM_002529.

FIGS. 33A-33B show nucleotide and amino acid sequences corresponding to an NTRK1-BGLAP fusion identified in lung adenocarcinoma. This fusion of NTRK1 (exons 1-11 NM_002529)-BGLAP (exons 2-4 NM_199173) resulted from a duplication rearrangement with the following breakpoints: chr1:156845233 and chr1:156211955. FIG. 33A shows the transcript sequence of the NTRK1-BGLAP fusion (SEQ ID NO: 204). FIG. 33B shows the amino acid sequence of the NTRK1-BGLAP fusion (SEQ ID NO: 205). The RNA and amino acid sequences shown in FIGS. 33A and 33B are predictive, since the breakpoint, frame and splicing results were unclear. DNA data suggested an NTRK1 breakpoint in intron 11 and a BGLAP breakpoint in exon 1, 5' UTR. Thus, intron 1 may be spliced out and skip exon 1 in BGLAP. The sequences provided in FIGS. 33A-33B can be found by searching for the Accession Number in the GenBank database of NIH. For example, the following link can be used: www.ncbi.nlm.nih.gov/nuccore/NM_002529 to search for Accession Number=NM_199173. Similarly, the following link can be used: www.ncbi.nlm.nih.gov/nuccore/NM_199173 to search for Accession Number=NM_002529.

FIGS. 34A-34B show nucleotide and amino acid sequences corresponding to a THADA-NTRK2 fusion identified in ovary serous carcinoma. This fusion of THADA (exons 1-36 NM_022065)-NTRK2 (exons 9-19 NM_006180) resulted from a Chr2:Chr9 translocation with the following breakpoints: chr2:43472620 and chr9:87342768. FIG. 34A shows the transcript sequence of the THADA-NTRK2 fusion (SEQ ID NO: 206). FIG. 34B shows the amino acid sequence of the THADA-NTRK2 fusion (SEQ ID NO: 207). The RNA and amino acid sequences shown in FIGS. 34A and 34B are predictive, since the breakpoint, frame and splicing results were unclear. DNA data suggested a THADA breakpoint in intron 36 and an NTRK2 breakpoint in exon 9. Thus, intron 9 may be spliced out and skip exon 9 in NTRK2. The sequences provided in FIGS. 34A-34B can be found by searching for the Accession Number in the GenBank database of NIH. For example, the following link can be used: www.ncbi.nlm.nih.gov/nuccore/NM_022065 to search for Accession Number=NM_022065. Similarly, the following link can be used: www.ncbi.nlm.nih.gov/nuccore/NM_006180 to search for Accession Number=NM_006180.

FIGS. 35A-35B show nucleotide and amino acid sequences corresponding to a PKM-NTRK3 fusion identified in bone osteosarcoma. This fusion of PKM (exons 1-1 UTR NM_002654)-NTRK3 (exons 4-19 NM_002530) resulted from a fusion rearrangement with the following breakpoints: chr15:72523457 and chr15:88727530. FIG. 35A shows the transcript sequence of the PKM-NTRK3 fusion (SEQ ID NO: 208). FIG. 35B shows the amino acid sequence of the PKM-NTRK3 fusion (SEQ ID NO: 209). The RNA and amino acid sequences shown in FIGS. 35A and 35B are predictive, since frame and splicing results were unclear. RNA data suggested fusion of PKM exon 1, 5' UTR to NTRK3. The splicing and protein sequence results were unclear. The sequences provided in FIGS. 35A-35B can be found by searching for the Accession Number in the GenBank database of NIH. For example, the following link can be used: www.ncbi.nlm.nih.gov/nuccore/NM_002654 to search for Accession Number=NM_002654. Similarly, the following link can be used: www.ncbi.nlm.nih.gov/nuccore/NM_002530 to search for Accession Number=NM_002530.

FIGS. 36A-36D depict the nucleotide sequence and corresponding amino acid sequence of NTRK1 transcripts NM_002529 and NM_001007792. FIG. 36A shows the nucleotide sequence of NTRK1 transcript NM_002529 (SEQ ID NO: 186). FIG. 36B shows the nucleotide sequence of NTRK1 transcript NM_001007792 (SEQ ID NO: 187). FIG. 36C shows the amino acid sequence of NTRK1 transcript NM_002529 (SEQ ID NO: 188). FIG. 36D shows the amino acid sequence of NTRK1 transcript NM_001007792 (SEQ ID NO: 189). The sequences provided in FIGS. 36A-36D can be found by searching for the Accession Number in the GenBank database of NIH. For example, the following link can be used: www.ncbi.nlm.nih.gov/nuccore/NM_002529 to search for Accession Number=NM_002529. Similarly, the following link can be used: www.ncbi.nlm.nih.gov/nuccore/NM_001007792 to search for Accession Number=NM_001007792.

FIGS. 37A-37C depict nucleotide and corresponding amino acid sequences of NTRK2 transcript NM_006180. FIG. 37A shows a nucleotide sequence of NTRK2 transcript NM_006180 (SEQ ID NO: 190). FIG. 37B shows the amino acid sequence of NTRK2 transcript NM_006180 (SEQ ID NO: 191). FIG. 37C depicts a nucleotide sequence of NTRK2 transcript NM_006180 (SEQ ID NO: 194). The first and last nucleotides in each exon are shown in bold and underlined to indicate exon boundaries. The start codon is shown in bold and italics. The stop codon is shown in italics and underlined. The sequences provided in FIGS. 37A-37C can be found by searching for the Accession Number in the GenBank database of NIH. For example, the following link can be used: www.ncbi.nlm.nih.gov/nuccore/NM_006180 to search for Accession Number=NM_006180.

FIGS. 38A-38B depict the nucleotide sequence and corresponding amino acid sequence of NTRK3 transcript NM_002530. FIG. 38A shows the nucleotide sequence of NTRK3 transcript NM_002530 (SEQ ID NO: 192). FIG. 38B shows the amino acid sequence of NTRK3 transcript NM_002530 (SEQ ID NO: 193). The sequences provided in FIGS. 38A-38B can be found by searching for the Accession Number in the GenBank database of NIH. For example, the following link can be used: www.ncbi.nlm.nih.gov/nuccore/NM_002530 to search for Accession Number=NM_002530.

DETAILED DESCRIPTION

The disclosure is based, at least in part, on the discovery of novel fusion events, and their association with cancer. In particular, the present disclosure relates generally to rearrangement events that give rise to NTRK1, NTRK2, or NTRK3 gene fusions.

In some embodiments, the present disclosure relates to NTRK1 rearrangement events that give rise to fusion molecules that include all or part of MEX3A (MEX-3 RNA Binding Family Member A) and all or part of NTRK1 (Neurotrophic Tyrosine Kinase Receptor Type 1), referred to herein as "MEX3A-NTRK1 fusion molecules" are disclosed. For example, a fragment of the MEX3A gene and a fragment of the NTRK1 gene, e.g., a fusion that includes a 5'-exon and a 3'-exon summarized in FIGS. 1A-1C (e.g., corresponding to exon 1 from MEX3A and exons 9-17 of NTRK1).

In some embodiments, the present disclosure relates to NTRK3 rearrangement events that give rise to fusion molecules that include all or part of CARM1 (Coactivator-associated Arginine Methyltransferase 1) and all or part of NTRK3 (Neurotrophic Tyrosine Kinase Receptor Type 3), referred to herein as "CARM1-NTRK3 fusion molecules" are disclosed. For example, a fragment of the CARM1 gene and a fragment of an NTRK3 gene, e.g., a fusion that includes a 5'-exon and a 3'-exon summarized in FIGS. 1A-1C (e.g., corresponding to exons 1-3 from CARM1 and exons 3-19 of NTRK3).

In some embodiments, the present disclosure relates to NTRK1 rearrangement events that give rise to fusion molecules that include all or part a gene of Table A and all or part of NTRK1 (Neurotrophic Tyrosine Kinase Receptor Type 1), referred to herein as "NTRK1 fusion molecules" are disclosed. For example, NTRK1 fusion molecules including a Breakpoint 1 and/or a Breakpoint 2 of Table E or a rearrangement of Table E are provided herein.

In some embodiments, the present disclosure relates to NTRK2 rearrangement events that give rise to fusion molecules that include all or part a gene of Table F and all or part of NTRK2 (Neurotrophic Tyrosine Kinase Receptor Type 2), referred to herein as "NTRK2 fusion molecules" are disclosed. For example, NTRK2 fusion molecules including a Breakpoint 1 and/or a Breakpoint 2 of Table J or a rearrangement of Table J are provided herein.

In some embodiments, the present disclosure relates to NTRK3 rearrangement events that give rise to fusion molecules that include all or part a gene of Table K and all or part of NTRK3 (Neurotrophic Tyrosine Kinase Receptor Type 3), referred to herein as "NTRK3 fusion molecules" are disclosed. For example, NTRK3 fusion molecules including a Breakpoint 1 and/or a Breakpoint 2 of Table O or a rearrangement of Table O are provided herein.

Certain types of cancer associated with NTRK fusions (e.g., NTRK1, NTRK2, or NTRK3 gene fusions), such as certain types of cancer described herein (e.g., vagina melanomas), are particularly aggressive and difficult to treat (see, e.g., Kalampokas et al. In Vivo. 2017; 31(1): 133-140). Without wishing to be bound by theory, it is believed that kinase inhibitors, such as NTRK inhibitors (e.g., larotrectinib or entrectinib), may benefit patients harboring NTRK fusion molecules (e.g., MEX3A-NTRK1 fusion molecules, CARM1-NTRK3 fusion molecules, NTRK1 fusion molecules, NTRK2 fusion molecules, or NTRK3 fusion molecules described herein). Thus, without wishing to be bound by theory, it is further believed that in some embodiments, it is important to identify NTRK fusion partners in order to identify NTRK rearrangement events (e.g., NTRK fusions) that may respond to a kinase inhibitor. For example, kinase inhibitors may not be effective in treating cancers when the NTRK rearrangement event is an NTRK duplication or truncating rearrangement. NTRK fusions can be identified, e.g., using proper bait selection strategies.

General Techniques

The techniques and procedures described or referenced herein are generally well understood and commonly employed using conventional methodology by those skilled in the art, such as, for example, the widely utilized methodologies described in Sambrook et al., *Molecular Cloning: A Laboratory Manual* 3d edition (2001) Cold Spring Harbor Laboratory Press, Cold Spring Harbor, N.Y.; *Current Protocols in Molecular Biology* (F. M. Ausubel, et al. eds., (2003)); the series *Methods in Enzymology* (Academic Press, Inc.): *PCR 2: A Practical Approach* (M. J. MacPherson, B. D. Hames and G. R. Taylor eds. (1995)), Harlow and Lane, eds. (1988) *Antibodies, A Laboratory Manual*, and *Animal Cell Culture* (R. I. Freshney, ed. (1987)); *Oligonucleotide Synthesis* (M. J. Gait, ed., 1984); *Methods in Molecular Biology*, Humana Press; *Cell Biology: A Laboratory Notebook* (J. E. Cellis, ed., 1998) Academic Press; *Animal Cell Culture* (R. I. Freshney), ed., 1987); *Introduction to Cell and Tissue Culture* (J. P. Mather and P. E. Roberts, 1998) Plenum Press; *Cell and Tissue Culture: Laboratory Procedures* (A. Doyle, J. B. Griffiths, and D. G. Newell, eds., 1993-8) J. Wiley and Sons; *Handbook of Experimental Immunology* (D. M. Weir and C. C. Blackwell, eds.); *Gene Transfer Vectors for Mammalian Cells* (J. M. Miller and M. P. Calos, eds., 1987); *PCR: The Polymerase Chain Reaction*, (Mullis et al., eds., 1994); *Current Protocols in Immunology* (J. E. Coligan et al., eds., 1991); *Short Protocols in Molecular Biology* (Wiley and Sons, 1999); *Immunobiology* (C. A. Janeway and P. Travers, 1997); *Antibodies* (P. Finch, 1997); *Antibodies: A Practical Approach* (D. Catty., ed., IRL Press, 1988-1989); *Monoclonal Antibodies: A Practical Approach* (P. Shepherd and C. Dean, eds., Oxford University Press, 2000); *Using Antibodies: A Laboratory Manual* (E. Harlow and D. Lane (Cold Spring Harbor Laboratory Press, 1999); *The Antibodies* (M. Zanetti and J. D. Capra, eds., Harwood Academic Publishers, 1995); and *Cancer: Principles and Practice of Oncology* (V. T. DeVita et al., eds., J.B. Lippincott Company, 1993).

Definitions

Certain terms are first defined in this section. Additional terms are defined throughout the specification.

As used herein, the articles "a" and "an" refer to one or to more than one (e.g., to at least one) of the grammatical object of the article.

The term "or" is used herein to mean, and is used interchangeably with, the term "and/or", unless context clearly indicates otherwise.

"About" and "approximately" shall generally mean an acceptable degree of error or deviation for the quantity measured given the nature or precision of the measurements. Exemplary degrees of error are within 20 percent (%), typically, within 10%, and more typically, within 5% of a given value or range of values.

"Acquire" or "acquiring" as the terms are used herein, refer to obtaining possession of a physical entity, or a value, e.g., a numerical value, by "directly acquiring" or "indirectly acquiring" the physical entity or value. "Directly acquiring" means performing a process (e.g., performing a synthetic or analytical method) to obtain the physical entity or value. "Indirectly acquiring" refers to receiving the physical entity or value from another party or source (e.g., a third-party laboratory that directly acquired the physical entity or value). Directly acquiring a physical entity includes performing a process that includes a physical change in a physical substance, e.g., a starting material. Exemplary changes include making a physical entity from two or more starting materials, shearing or fragmenting a substance, separating or purifying a substance, combining two or more separate entities into a mixture, performing a chemical reaction that includes breaking or forming a covalent or non-covalent bond. Directly acquiring a value includes performing a process that includes a physical change in a sample or another substance, e.g., performing an analytical process which includes a physical change in a substance, e.g., a sample, analyte, or reagent (sometimes referred to herein as "physical analysis"), performing an analytical method, e.g., a method which includes one or more of the following: separating or purifying a substance, e.g., an analyte, or a fragment or other derivative thereof, from another substance; combining an analyte, or fragment or other derivative thereof, with another substance, e.g., a buffer, solvent, or reactant; or changing the structure of an analyte, or a fragment or other derivative thereof, e.g., by breaking or forming a covalent or non-covalent bond, between a first and a second atom of the analyte; or by changing the structure of a reagent, or a fragment or other derivative thereof, e.g., by breaking or forming a covalent or non-covalent bond, between a first and a second atom of the reagent.

"Acquiring a sequence" or "obtaining a sequence" as the terms are used herein, refer to obtaining possession of a nucleotide sequence or amino acid sequence, by "directly acquiring" or "directly obtaining" or "indirectly acquiring" or "indirectly obtaining" the sequence. "Directly acquiring a sequence" or "directly obtaining a sequence" means performing a process (e.g., performing a synthetic or analytical method) to obtain the sequence, such as performing a sequencing method (e.g., a Next Generation Sequencing (NGS) method). "Indirectly acquiring a sequence" or "indirectly obtaining a sequence" refers to receiving information or knowledge of, or receiving, the sequence from another party or source (e.g., a third party laboratory that directly acquired the sequence). The sequence acquired or obtained need not be a full sequence, e.g., sequencing of at least one nucleotide, or obtaining information or knowledge, that identifies a fusion molecule disclosed herein as being present in a subject constitutes acquiring a sequence.

Directly acquiring or obtaining a sequence includes performing a process that includes a physical change in a physical substance, e.g., a starting material, such as a tissue sample, e.g., a biopsy, or a nucleic acid (e.g., DNA or RNA) sample. Exemplary changes include making a physical entity from two or more starting materials, shearing or fragmenting a substance, such as a genomic DNA fragment; separating or purifying a substance (e.g., isolating a nucleic acid sample from a tissue); combining two or more separate entities into a mixture, performing a chemical reaction that includes breaking or forming a covalent or non-covalent bond.

"Acquiring a sample" of "obtaining a sample" as the terms are used herein, refer to obtaining possession of a sample, e.g., a tissue sample or nucleic acid sample, by "directly acquiring" of "directly obtaining" or "indirectly acquiring" of "indirectly obtaining" the sample. "Directly acquiring a sample" or "directly obtaining a sample" means performing a process (e.g., performing a physical method such as a surgery or extraction) to obtain the sample. "Indirectly acquiring a sample" or "indirectly obtaining a sample" refers to receiving the sample from another party or source (e.g., a third-party laboratory that directly acquired or obtained the sample). Directly acquiring or obtaining a sample includes performing a process that includes a physical change in a physical substance, e.g., a starting material, such as a tissue, e.g., a tissue in a human patient or a tissue that has was previously isolated from a patient. Exemplary changes include making a physical entity from a starting material, dissecting or scraping a tissue; separating or purifying a substance (e.g., a sample tissue or a nucleic acid sample); combining two or more separate entities into a mixture; performing a chemical reaction that includes breaking or forming a covalent or non-covalent bond. Directly acquiring or obtaining a sample includes performing a process that includes a physical change in a sample or another substance, e.g., as described above.

"Binding entity" means any molecule to which molecular tags can be directly or indirectly attached that is capable of specifically binding to an analyte. The binding entity can be an affinity tag on a nucleotide sequence. In certain embodiments, the binding entity allows for separation of the nucleic acid from a mixture, such as an avidin molecule, or an antibody that binds to the hapten or an antigen-binding fragment thereof. Exemplary binding entities include, e.g., a biotin molecule, a hapten, an antibody, an antibody binding fragment, a peptide, and a protein.

"Complementary" refers to sequence complementarity between regions of two nucleic acid strands or between two regions of the same nucleic acid strand. It is known that an adenine residue of a first nucleic acid region is capable of forming specific hydrogen bonds ("base pairing") with a residue of a second nucleic acid region which is antiparallel to the first region if the residue is thymine or uracil. Similarly, it is known that a cytosine residue of a first nucleic acid strand is capable of base pairing with a residue of a second nucleic acid strand which is antiparallel to the first strand if the residue is guanine. A first region of a nucleic acid is complementary to a second region of the same or a different nucleic acid if, when the two regions are arranged in an antiparallel fashion, at least one nucleotide residue of the first region is capable of base pairing with a residue of the second region. In certain embodiments, the first region comprises a first portion, and the second region comprises a second portion, whereby, when the first and second portions are arranged in an antiparallel fashion, at least about 50%, at least about 75%, at least about 90%, or at least about 95% of the nucleotide residues of the first portion are capable of base pairing with nucleotide residues in the second portion. In other embodiments, all nucleotide residues of the first portion are capable of base pairing with nucleotide residues in the second portion.

The term "cancer" or "tumor" is used interchangeably herein. These terms refer to the presence of cells possessing characteristics typical of cancer-causing cells, such as uncontrolled proliferation, immortality, metastatic potential, rapid growth and proliferation rate, and certain characteristic morphological features. Cancer cells are often in the form of a tumor, but such cells can exist alone within an animal, or can be a non-tumorigenic cancer cell, such as a leukemia cell. These terms include a solid tumor, a soft tissue tumor, or a metastatic lesion. As used herein, the term "cancer" includes premalignant, as well as malignant cancers. In certain embodiments, the cancer is a solid tumor, a soft tissue tumor, or a metastatic lesion.

The term "neoplasm" or "neoplastic" cell refers to an abnormal proliferative stage, e.g., a hyperproliferative stage, in a cell or tissue that can include a benign, pre-malignant, malignant (cancer) or metastatic stage.

Cancer is "inhibited" if at least one symptom of the cancer is alleviated, terminated, slowed, or prevented. As used herein, cancer is also "inhibited" if recurrence or metastasis of the cancer is reduced, slowed, delayed, or prevented.

"Chemotherapeutic agent" means a chemical substance, such as a cytotoxic or cytostatic agent, that is used to treat a condition, particularly cancer.

As used herein, "cancer therapy" and "cancer treatment" are synonymous terms.

As used herein, "chemotherapy" and "chemotherapeutic" and "chemotherapeutic agent" are synonymous terms.

The terms "homology" or "identity," as used interchangeably herein, refer to sequence similarity between two polynucleotide sequences or between two polypeptide sequences, with identity being a stricter comparison. The phrases "percent identity or homology" and "% identity or homology" refer to the percentage of sequence similarity found in a comparison of two or more polynucleotide sequences or two or more polypeptide sequences. "Sequence similarity" refers to the percent similarity in base pair sequence (as determined by any suitable method) between two or more polynucleotide sequences. Two or more sequences can be anywhere from 0-100% similar, or any integer value there between. Identity or similarity can be determined by comparing a position in each sequence that can be aligned for purposes of comparison. When a position in the compared sequence is occupied by the same nucleotide base or amino acid, then the molecules are identical at that position. A degree of similarity or identity between polynucleotide sequences is a function of the number of identical or matching nucleotides at positions shared by the polynucleotide sequences. A degree of identity of polypeptide sequences is a function of the number of identical amino acids at positions shared by the polypeptide sequences. A degree of homology or similarity of polypeptide sequences is a function of the number of amino acids at positions shared by the polypeptide sequences. The term "substantially identical," as used herein, refers to an identity or homology of at least 75%, at least 80%, at least 85%, at least 90%, 91%, 92%, 93%, 94%, 95%, 96%, 97%, 98%, 99%, or more. "Likely to" or "increased likelihood," as used herein, refers to an increased probability that an item, object, thing or person will occur. Thus, in one example, a subject that is likely to respond to treatment with a kinase inhibitor, alone or in combination, has an increased probability of responding to treatment with the inhibitor alone or in combination, relative to a reference subject or group of subjects.

"Unlikely to" refers to a decreased probability that an event, item, object, thing or person will occur with respect to a reference. Thus, a subject that is unlikely to respond to treatment with a kinase inhibitor, alone or in combination, has a decreased probability of responding to treatment with a kinase inhibitor, alone or in combination, relative to a reference subject or group of subjects.

"Sequencing" a nucleic acid molecule requires determining the identity of at least 1 nucleotide in the molecule. In some embodiments, the identity of less than all of the nucleotides in a molecule are determined. In other embodiments, the identity of a majority or all of the nucleotides in the molecule is determined.

"Next-generation sequencing" or "NGS" or "NG sequencing" as used herein, refers to any sequencing method that determines the nucleotide sequence of either individual nucleic acid molecules (e.g., in single molecule sequencing) or clonally expanded proxies for individual nucleic acid molecules in a highly parallel fashion (e.g., greater than 105 molecules are sequenced simultaneously). In one embodiment, the relative abundance of the nucleic acid species in a library can be estimated by counting the relative number of occurrences of their cognate sequences in the data generated by the sequencing experiment. Next generation sequencing methods are known in the art, and are described, e.g., in Metzker, M. (2010) *Nature Biotechnology Reviews* 11:31-46, incorporated herein by reference. Next generation sequencing can detect a variant present in less than 5% of the nucleic acids in a sample.

"Sample," as used herein, refers to a biological sample obtained or derived from a source of interest, as described herein. In some embodiments, a source of interest comprises an organism, such as an animal or human. The source of the sample can be solid tissue as from a fresh, frozen and/or preserved organ, tissue sample, biopsy, resection, smear, or aspirate; blood or any blood constituents; bodily fluids such as cerebral spinal fluid, amniotic fluid, peritoneal fluid or interstitial fluid; or cells from any time in gestation or development of the subject. In some embodiments, the source of the sample is blood or blood constituents.

In some embodiments, the sample is or comprises biological tissue or fluid. The sample can contain compounds that are not naturally intermixed with the tissue in nature such as preservatives, anticoagulants, buffers, fixatives, nutrients, antibiotics or the like. In one embodiment, the sample is preserved as a frozen sample or as a formaldehyde- or paraformaldehyde-fixed paraffin-embedded (FFPE) tissue preparation. For example, the sample can be embedded in a matrix, e.g., an FFPE block or a frozen sample. In another embodiment, the sample is a blood or blood constituent sample. In yet another embodiment, the sample is a bone marrow aspirate sample. In another embodiment, the sample comprises cell-free DNA (cfDNA). Without wishing to be bound by theory, it is believed that in some embodiments, cfDNA is DNA from apoptosed or necrotic cells. Typically, cfDNA is bound by protein (e.g., histone) and protected by nucleases. CfDNA can be used as a biomarker, for example, for non-invasive prenatal testing (NIPT), organ transplant, cardiomyopathy, microbiome, and cancer. In another embodiment, the sample comprises circulating tumor DNA (ctDNA). Without wishing to be bound by theory, it is believed that in some embodiments, ctDNA is cfDNA with a genetic or epigenetic alteration (e.g., a somatic alteration or a methylation signature) that can discriminate it originating from a tumor cell versus a non-tumor cell. In another embodiment, the sample comprises circulating tumor cells (CTCs). Without wishing to be bound by theory, it is believed that in some embodiments, CTCs are cells shed from a primary or metastatic tumor into the circulation. In some embodiments, CTCs apoptose and are a source of ctDNA in the blood/lymph.

In some embodiments, a biological sample may be or comprise bone marrow; blood; blood cells; ascites; tissue or fine needle biopsy samples; cell-containing body fluids; free floating nucleic acids; sputum; saliva; urine; cerebrospinal fluid, peritoneal fluid; pleural fluid; feces; lymph; gynecological fluids; skin swabs; vaginal swabs; oral swabs; nasal swabs; washings or lavages such as ductal lavages or bronchoalveolar lavages; aspirates; scrapings; bone marrow specimens; tissue biopsy specimens; surgical specimens; feces, other body fluids, secretions, and/or excretions; and/or cells therefrom, etc. In some embodiments, a biological sample is or comprises cells obtained from an individual. In some embodiments, obtained cells are or include cells from an individual from whom the sample is obtained.

In some embodiments, a sample is a "primary sample" obtained directly from a source of interest by any appropriate means. For example, in some embodiments, a primary biological sample is obtained by a method chosen from biopsy (e.g., fine needle aspiration or tissue biopsy), surgery, collection of body fluid (e.g., blood, lymph, or feces), etc. In some embodiments, as will be clear from context, the term "sample" refers to a preparation that is obtained by processing (e.g., by removing one or more components of and/or by adding one or more agents to) a primary sample, e.g., filtering using a semi-permeable membrane. Such a "processed sample" may comprise, for example nucleic acids or proteins extracted from a sample or obtained by subjecting a primary sample to techniques such as amplification or reverse transcription of mRNA, isolation and/or purification of certain components, etc.

In an embodiment, the sample is a cell associated with a tumor, e.g., a tumor cell or a tumor-infiltrating lymphocyte (TIL). In one embodiment, the sample includes one or more premalignant or malignant cells. In an embodiment, the sample is acquired from a hematologic malignancy (or premaligancy), e.g., a hematologic malignancy (or premaligancy) described herein. In some embodiments, the sample is acquired from a solid tumor, a soft tissue tumor or a metastatic lesion. In other embodiments, the sample includes tissue or cells from a surgical margin. In another embodiment, the sample includes one or more circulating tumor cells (CTCs) (e.g., a CTC acquired from a blood sample). In an embodiment, the sample is a cell not associated with a tumor, e.g., a non-tumor cell or a peripheral blood lymphocyte.

"Tumor nucleic acid sample," as used herein, refers to nucleic acid molecules from a tumor or cancer sample. Typically, it is DNA, e.g., genomic DNA, or cDNA derived from RNA, from a tumor or cancer sample. In certain embodiments, the tumor nucleic acid sample is purified or isolated (e.g., it is removed from its natural state).

"Control nucleic acid sample" or "reference nucleic acid sample," as used herein, refers to nucleic acid molecules from a control or reference sample. Typically, it is DNA, e.g., genomic DNA, or cDNA derived from RNA, not containing the alteration or variation in the gene or gene product, e.g., not containing a fusion molecule described herein. In certain embodiments, the reference or control nucleic acid sample is a wildtype or a non-mutated sequence. In certain embodiments, the reference nucleic acid sample is purified or isolated (e.g., it is removed from its natural state). In other embodiments, the reference nucleic acid sample is from a non-tumor sample, e.g., a blood control, a normal adjacent tumor (NAT), or any other non-cancerous sample from the same or a different subject.

"Adjacent to the interrogation position," as used herein, means that a site is sufficiently close such that a detection reagent complementary with the site can be used to distinguish between a mutation, e.g., a mutation described herein, and a reference sequence, e.g., a non-mutant or wildtype sequence, in a target nucleic acid. Directly adjacent, as used herein, is where 2 nucleotides have no intervening nucleotides between them.

"Associated mutation," as used herein, refers to a mutation within a preselected distance, in terms of nucleotide or primary amino acid sequence, from a definitional mutation, e.g., a mutant as described herein, e.g., a translocation, breakpoint or fusion molecule described herein. In some embodiments, the associated mutation is within n, wherein n is 2, 5, 10, 20, 30, 50, 100, or 200 nucleotides from the definitional mutation (n does not include the nucleotides defining the associated and definitional mutations). In some embodiments, the associated mutation is a translocation mutation.

"Interrogation position," as used herein, comprises at least one nucleotide (or, in the case of polypeptides, at least one an amino acid residue) which corresponds to a nucleotide (or amino acid residue) that is mutated in a mutation, including, e.g., in the case of a rearrangement, one or both of the nucleotide (or amino acid) residues flanking the breakpoint, or other residue which can be used to distinguish the mutation, of interest, e.g., a mutation being identified, or in a nucleic acid (or protein) being analyzed, e.g., sequenced, or recovered. By way of example, the interrogation position in the breakpoint shown in FIG. 1A, 1B, or 1C, includes one, two, or more nucleotide positions at the junction site.

"Reference sequence," as used herein, e.g., as a comparator for a mutant sequence, is a sequence which has a different nucleotide or amino acid at an interrogation position than does the mutant(s) being analyzed. In an embodiment, the reference sequence is wildtype for at least the interrogation position.

The term "variant," as used herein, refers to a molecule that is substantially identical (e.g., at least 75%, 80%, 85%, 90%, 91%, 92%, 93%, 94%, 95%, 96%, 97%, 98%, 99%, or more identical) a fusion molecule described herein or a fragment thereof.

Headings, e.g., (a), (b), (i) etc., are presented merely for ease of reading the specification and claims. The use of headings in the specification or claims does not require the steps or elements be performed in alphabetical or numerical order or the order in which they are presented.

Various aspects featured in the disclosure are described in further detail below.

Neurotrophic Receptor Tyrosine Kinase 1, 2, and 3

Neurotrophic Receptor Tyrosine Kinase 1 (NTRK1) encodes the receptor tyrosine kinase TRKA, which regulates cell proliferation, differentiation, and survival of neurons by activating several downstream pathways that also play a role in tumorigenesis (e.g., GRB2-RAS-MAPK and RAS-PI3K-AKT1). NTRK1 fusions that include an N-terminal oligomerization-promoting partner gene linked to the kinase domain of TRKA have been characterized as activating, exhibiting constitutive kinase activity and tyrosine phosphorylation. The frequency of NTRK1 fusions is relatively low in common solid tumors and hematological malignancies (<5%) and is higher in several rare solid tumors (>80%), such as infantile fibrosarcoma and cellular and mixed congenital mesoblastic nephroma (Penault-Llorca et al., 2019; 31072837).

Neurotrophic Receptor Tyrosine Kinase 1 (NTRK2) encodes the receptor tyrosine kinase TRKB, a neurotrophic tyrosine kinase receptor family member regulating cell proliferation, differentiation, and survival of neurons by activating several downstream pathways that also play a role in tumorigenesis (e.g., RAS-MAPK and PI3K-AKT1). NTRK2 fusions that include an N-terminal oligomerization-promoting partner gene linked to the kinase domain of TRKB have been characterized as activating, exhibiting constitutive kinase activity and tyrosine phosphorylation. NTRK2 fusions have been reported in <5% of certain common solid tumors and hematological malignancies, and they have been reported in 5%-25% of melanoma and pediatric high-grade gliomas (Penault-Llorca et al., 2019; 31072837).

Neurotrophic Receptor Tyrosine Kinase 1 (NTRK3) encodes the receptor tyrosine kinase TRKC, a neurotrophic tyrosine kinase receptor family member regulating cell proliferation, differentiation, and survival of neurons by activating several downstream pathways that also play a role in tumorigenesis (e.g., RAS-MAPK and PI3K-AKT1). NTRK3 fusions that include an N-terminal oligomerization-promoting partner gene linked to the kinase domain of TRKC have been characterized as activating, exhibiting constitutive kinase activity and tyrosine phosphorylation. NTRK3 fusions have been reported in <5% of certain common solid tumors and hematological malignancies, and they have been reported in 5%-25% of papillary thyroid cancer and Spitz tumors and in >80% of secretory breast carcinomas and several rare solid tumors, such as infantile fibrosarcoma and cellular and mixed congenital mesoblastic nephroma (Penault-Llorca et al., 2019; 31072837).

NTRK activating fusions may predict sensitivity to FDA-approved TRK inhibitors (e.g., larotrectinib or entrectinib), investigational TRK inhibitors (e.g., AZD7451, belizatinib, selitrectinib, or PLX7486), and crizotinib.

Fusion Nucleic Acid Molecules

One aspect featured in the disclosure pertains to fusion nucleic acid molecules (e.g., isolated fusion nucleic acid molecules) that include a nucleotide sequence described herein, including nucleic acid molecules which encode a fusion polypeptide or a portion of such a polypeptide, as described herein. The fusion nucleic acid molecules include those which reside in genomic regions identified herein. As used herein, the term "nucleic acid molecule" includes DNA molecules (e.g., cDNA or genomic DNA) and RNA molecules (e.g., mRNA) and analogs of the DNA or RNA generated using nucleotide analogs. The nucleic acid molecule can be single-stranded or double-stranded; in certain embodiments, the nucleic acid molecule is double-stranded DNA.

Fusion nucleic acid molecules also include nucleic acid molecules sufficient for use as hybridization probes or primers to identify nucleic acid molecules that correspond to a fusion molecule described herein, e.g., those suitable for use as PCR primers for the amplification or mutation of nucleic acid molecules.

An "isolated" nucleic acid molecule is one which is separated from other nucleic acid molecules which are present in the natural source of the nucleic acid molecule. In certain embodiments, an "isolated" nucleic acid molecule is free of sequences (such as protein-encoding sequences) which naturally flank the nucleic acid (i.e., sequences located at the 5' and 3' ends of the nucleic acid) in the genomic DNA of the organism from which the nucleic acid is derived. For example, in various embodiments, the fusion nucleic acid molecule can contain less than about 5 kB, less than about 4 kB, less than about 3 kB, less than about 2 kB, less than about 1 kB, less than about 0.5 kB or less than about 0.1 kB of nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

The language "substantially free of other cellular material or culture medium" includes preparations of a nucleic acid molecule in which the molecule is separated from cellular components of the cells from which it is isolated or recombinantly produced. Thus, a nucleic acid molecule that is substantially free of cellular material includes preparations of the nucleic acid molecule having less than about 30%, less than about 20%, less than about 10%, or less than about 5% (by dry weight) of other cellular material or culture medium.

A fusion nucleic acid molecule can be isolated using standard molecular biology techniques and the sequence information in the database records described herein. Using all or a portion of such nucleotide sequences, fusion nucleic acid molecules as described herein can be isolated using standard hybridization and cloning techniques (e.g., as described in Sambrook et al., ed., *Molecular Cloning: A Laboratory Manual,* 2nd ed., Cold Spring Harbor Laboratory Press, Cold Spring Harbor, N.Y., 1989).

A fusion nucleic acid molecule (e.g., fusion molecule described herein) can be amplified using cDNA, mRNA, or genomic DNA as a template and appropriate oligonucleotide primers according to standard PCR amplification techniques. The nucleic acid molecules so amplified can be cloned into an appropriate vector and characterized by DNA sequence analysis. Furthermore, oligonucleotides corresponding to all or a portion of a nucleic acid molecule featured in the disclosure can be prepared by standard synthetic techniques, e.g., using an automated DNA synthesizer.

In another embodiment, the fusion nucleic acid molecule comprises a nucleotide sequence complementary to the nucleotide sequence of a fusion nucleic acid molecule described herein or to the nucleotide sequence of a nucleic acid molecule encoding a fusion protein described herein. A nucleic acid molecule which is complementary to a given nucleotide sequence is one which is sufficiently complementary to the given nucleotide sequence that it can hybridize (e.g., under stringent hybridization conditions) to the given nucleotide sequence thereby forming a stable duplex.

Moreover, a fusion nucleic acid molecule can comprise only a portion of a nucleotide sequence described herein. Such nucleic acid molecules can be used, for example, as probes or primers. A probe/primer typically is used as one or more substantially purified oligonucleotides. The oligonucleotide typically comprises a region of nucleotide sequence that hybridizes under stringent conditions to at least about 7, at least about 15, at least about 25, at least about 50, at least about 75, at least about 100, at least about 125, at least about 150, at least about 175, at least about 200, at least about 250, at least about 300, at least about 350, at least about 400, at least about 500, at least about 600, at least about 700, at least about 800, at least about 900, at least about 1 kb, at least about 2 kb, at least about 3 kb, at least about 4 kb, at least about 5 kb, at least about 6 kb, at least about 7 kb, at least about 8 kb, at least about 9 kb, at least about 10 kb, at least about 15 kb, at least about 20 kb, at least about 25 kb, at least about 30 kb, at least about 35 kb, at least about 40 kb, at least about 45 kb, at least about 50 kb, at least about 60 kb, at least about 70 kb, at least about 80 kb, at least about 90 kb, at least about 100 kb, at least about 200 kb, at least about 300 kb, at least about 400 kb, at least about 500 kb, at least about 600 kb, at least about 700 kb, at least about 800 kb, at least about 900 kb, at least about 1 mb, at least about 2 mb, at least about 3 mb, at least about 4 mb, at least about 5 mb, at least about 6 mb, at least about 7 mb, at least about 8 mb, at least about 9 mb, at least about 10 mb or more consecutive nucleotides of a fusion nucleic acid described herein.

In some embodiments, the fusion nucleic acid molecule comprises a nucleotide sequence that is substantially identical to a nucleotide sequence described herein, e.g., at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 99.5%, identical.

In other embodiments, the fusion nucleic acid molecule comprises a nucleotide sequence that is substantially homologous to a nucleotide sequence described herein, e.g., differing by only or at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 30, at least 40, at least 50, at least 60, at least 70, at least 80, at least 90, at least 100, at least 200, at least 300, at least 400, at least 500, at least 600 nucleotides, or any range in between.

In another embodiment, the fusion nucleic acid molecule is at least 7, at least 15, at least 20, at least 25, at least 30, at least 35, at least 40, at least 45, at least 50, at least 55, at least 60, at least 65, at least 70, at least 75, at least 80, at least 85, at least 90, at least 95, at least 100, at least 125, at least 150, at least 175, at least 200, at least 250, at least 300, at least 350, at least 400, at least 450, at least 500, at least 550, at least 650, at least 700, at least 800, at least 900, at least 1000, at least 1200, at least 1400, at least 1600, at least 1800, at least 2000, at least 2200, at least 2400, at least 2600, at least 2800, at least 3000, or more nucleotides and hybridizes under stringent conditions to a fusion nucleic acid molecule described herein.

As used herein, the term "hybridizes under stringent conditions" is intended to describe conditions for hybridization and washing under which nucleotide sequences at least 60%, at least 65%, at least 70%, at least 75%, at least 80%, or at least 85% identical to each other typically remain hybridized to each other. Such stringent conditions are known to those skilled in the art and can be found in sections 6.3.1-6.3.6 of *Current Protocols in Molecular Biology*, John Wiley & Sons, N.Y. (1989). Another, non-limiting example of stringent hybridization conditions are hybridization in 6×sodium chloride/sodium citrate (SSC) at about 45° C., followed by one or more washes in 0.2×SSC, 0.1% SDS at 50-65° C.

The disclosure also includes molecular beacon nucleic acid molecules having at least one region which is complementary to the nucleotide sequence of a fusion nucleic acid molecule described herein, such that the molecular beacon is useful for quantitating the presence of the nucleic acid molecule. A "molecular beacon" nucleic acid is a nucleic acid molecule comprising a pair of complementary regions and having a fluorophore and a fluorescent quencher associated therewith. The fluorophore and quencher are associated with different portions of the nucleic acid in such an orientation that when the complementary regions are annealed with one another, fluorescence of the fluorophore is quenched by the quencher. When the complementary regions of the nucleic acid molecules are not annealed with one another, fluorescence of the fluorophore is quenched to a lesser degree. Molecular beacon nucleic acid molecules are described, for example, in U.S. Pat. No. 5,876,930.

In some embodiments, the fusion nucleic acid molecule includes a genetic alteration, e.g., a rearrangement, as disclosed herein, e.g., in FIG. 1A or 1B, or in Tables C, H, M E, J, or O. Such a nucleic acid molecule or a preparation thereof can be used to detect, e.g., a genetic alteration disclosed herein, and to characterize a sample in which they are contained. The fusion nucleic acid molecule (e.g., isolated fusion nucleic acid molecule) can comprise a genomic or a transcribed sequence, e.g., a cDNA sequence.

In some embodiments, the fusion nucleic acid molecule includes a fragment of a first gene, and a fragment of a second gene, typically wherein at least one of the genes encodes a kinase. In some embodiments, the fusion nucleic acid molecule has the fusion partners described in FIG. 1A or 1B, or in Tables A, F, or K. In some embodiments, the fusion nucleic acid molecule comprises the entire sequence of a first fragment and the entire sequence of a second fragment, e.g., as shown in FIG. 1A or 1B or in Tables C, H, M E, J, or O.

In some embodiments, the fusion nucleic acid molecule is a genomic nucleic acid molecule comprising an entire genomic sequence, e.g., from the control region or beginning of the open reading frame, through the breakpoint, which may be in an intron or an exon, of a first gene, fused to a sequence for a second gene, which begins at its breakpoint and extends to the end of the second gene, e.g., through the end of the open reading frame of the second gene. In other embodiments, the fusion nucleic acid molecule includes a fusion junction, but only a portion of a first gene and a portion of a second gene.

In some embodiments, the fusion nucleic acid molecule is a transcribed nucleic acid, e.g., a cDNA or mRNA, and comprises a nucleotide sequence encoding the entire sequence, e.g., from the beginning of the mRNA through the breakpoint of a first gene fused to a sequence for a second gene, which begins at its breakpoint and extends to the end of the mRNA of the second gene. In other embodiments, the fusion nucleic acid molecule includes the fusion junction, but only a portion of a first gene and a portion of a second gene. In some embodiments, the transcribed nucleic acid has one or more exons from a first gene fused, in frame, to one or more exons of a second gene. In some embodiments, the transcribed nucleic acid comprises a fusion of a C-terminal exon of a first gene fragment with an N-terminal exon of a second gene. In some embodiments, the kinase activity of the second gene fragment is under the control of or modified or impacted by the first gene fragment in the fusion.

In some embodiments, the fusion nucleic acid molecule, e.g., a genomic or transcribed nucleic acid, e.g., a cDNA or RNA, comprises a fusion junction, e.g., a fusion junction from FIG. 1A or 1B, or from Tables E, J, or O (e.g., a Breakpoint 1 and/or a Breakpoint 2 or a rearrangement from Tables E, J, or O), and is at least 10, 20, 30, 40, 50, 60, 70, 80, 100, 125, 150, 200, 250, 300, 350, or 400 nucleotides, but optionally less than 1,000, 1,500, or 2,000 nucleotides. In some embodiments, the fusion nucleic acid molecule, e.g., a genomic or transcribed nucleic acid, e.g., a cDNA or RNA, comprises a fusion junction, e.g., a fusion junction from FIG. 1A or 1B, or from Tables E, J, or O (e.g., a Breakpoint 1 and/or a Breakpoint 2 or a rearrangement from Tables E, J, or O), and is between 10 and 2,000, 10 and 1,500, 10 and 1,000, 10 and 500, 10 and 400, 10 and 300, 10 and 200, 10 and 100, 20 and 2,000, 20 and 1,500, 20 and 1,000, 20 and 500, 20 and 400, 20 and 300, 20 and 200, 20 and 100, 30 and 2,000, 30 and 1,500, 30 and 1,000, 30 and 500, 30 and 400, 30 and 300, 30 and 200, or 30 and 100 nucleotides.

In one embodiment, the fusion nucleic acid molecule, e.g., a transcribed nucleic acid, e.g., a cDNA or RNA, comprises a fusion, e.g., an in-frame fusion, from FIG. 1B or from Tables C, H, or M, or a fusion transcribed from a genomic fusion from FIG. 1A or from Tables E, J, or O.

In an embodiment, the fusion nucleic acid molecule, e.g., a transcribed nucleic acid, e.g., a cDNA or RNA, comprises a fusion, e.g., an in-frame fusion, of the 3' terminus of an exon of a first gene of FIG. 1B or of Tables C, H, M to the 5' terminus of an exon of a second gene of FIG. 1B or of Tables C, H, M. In an embodiment, the fusion is between the specific exons listed in FIG. 1B or in Tables C, H, M. In some embodiments, the fusion is not between the specific exons described in FIG. 1B or in Tables C, H, M but is between other exons of the first gene to other exons of the second gene as described in FIG. 1B or in Tables C, H, M.

In an embodiment, the fusion nucleic acid molecule, e.g., a transcribed nucleic acid, e.g., a cDNA or RNA, comprises a fusion, e.g., an in-frame fusion, of the 3' terminus of an exon of a first gene of FIG. 1B or of Tables C, H, M to the 5' terminus of an exon of a second gene other than the second gene exon shown in FIG. 1B or in Tables C, H, M. By way of example, an exon, e.g., exon 2 of MEX3A is fused to an exon of NTRK1 other than the exon listed in FIG. 1B, e.g., it is fused to an exon other than exon 9 of NTRK1; or exon 3 of CARM1 is fused to an exon of NTRK3 other than the exon listed in FIG. 1B, e.g., it is fused to an exon other than exon 3 of NTRK3.

In an embodiment, the fusion nucleic acid molecule, e.g., a transcribed nucleic acid, e.g., a cDNA or RNA, comprises a fusion, e.g., an in-frame fusion, of the 5' terminus of an exon of a second gene of FIG. 1B or of Tables C, H, M to the 3' terminus of an exon of a first gene other than the exon of the first gene shown in FIG. 1B or in Tables C, H, M.

In an embodiment, the fusion nucleic acid molecule, e.g., a genomic or transcribed nucleic acid, e.g., a cDNA or RNA, comprises sufficient exonic sequence(s) of the second gene to confer kinase activity in the encoded polypeptide. In an embodiment, the fusion nucleic acid molecule, e.g., a genomic or transcribed nucleic acid, e.g., a cDNA or mRNA, comprises sufficient sequence(s) of the first gene to allow expression of the kinase activity of the second gene.

In some embodiments, the fusion is between genes that are fusion partners as described in FIG. 1A or 1B, or in Tables C, H, M, E, J, or O. In an embodiment, sufficient sequence from the second gene is present to confer kinase activity on an encoded protein and sufficient sequence is present from the first gene to provide for expression of the kinase activity of the second gene in an encoded protein. In an embodiment, sufficient sequence from the second gene is present to confer kinase activity on an encoded protein and sufficient sequence is present from the second gene to provide for expression of the kinase activity of the second gene in an encoded protein.

In an embodiment, the fusion nucleic acid molecule, e.g., a transcribed nucleic acid, e.g., a cDNA or RNA, comprises a fusion junction between a MEX3A gene (or a fragment thereof) and an NTRK1 gene (or a fragment thereof), wherein sufficient exonic sequence from the NTRK1 gene is present to confer a kinase activity and sufficient sequence of the MEX3A gene is present to allow expression of the kinase activity.

In an embodiment, the fusion nucleic acid molecule, e.g., a transcribed nucleic acid, e.g., a cDNA or RNA, comprises a fusion junction between a CARM1 gene (or a fragment thereof) and an NTRK3 gene (or a fragment thereof), wherein sufficient exonic sequence from the NTRK3 gene is present to confer a kinase activity and sufficient sequence of the CARM1 gene is present to allow expression of the kinase activity.

In some embodiments, the fusion nucleic acid molecule, e.g., a transcribed nucleic acid, e.g., a cDNA or RNA, comprises a fusion junction between a gene of Table A (or a fragment thereof) and an NTRK1 gene (or a fragment thereof), wherein sufficient exonic sequence from the NTRK1 gene is present to confer a kinase activity and sufficient sequence of the gene of Table A is present to allow expression of the kinase activity (e.g., a fusion between the exons described in Table C or a fusion as described in Table E).

In some embodiments, the fusion nucleic acid molecule, e.g., a transcribed nucleic acid, e.g., a cDNA or RNA, comprises a fusion junction between a gene of Table F (or a fragment thereof) and an NTRK2 gene (or a fragment thereof), wherein sufficient exonic sequence from the NTRK2 gene is present to confer a kinase activity and sufficient sequence of the gene of Table F is present to allow expression of the kinase activity (e.g., a fusion between the exons described in Table H or a fusion as described in Table J).

Also included are genomic fusion nucleic acid molecules that can be transcribed to provide a transcribed nucleic acid, e.g., a cDNA or RNA, described herein.

In one embodiment, the fusion nucleic acid molecule, e.g., a genomic nucleic acid, comprises a fusion of a first gene and a second gene from FIG. 1A or from Tables E, J, or O.

In some embodiments, the fusion nucleic acid molecule, e.g., a genomic sequence, comprises a fusion of the 3' terminus of a fragment of a first gene to the 5' terminus of a fragment of a second gene, shown in FIG. 1A or in Tables E, J, or O. In an embodiment, the 3' terminus of the fragment of the first gene is within 10, 20, 30, 40, 50 60, 70, 80, 90, or 100 nucleotides (in either direction) of the 3' terminus provided in FIG. 1A or in Tables E, J, or O for the first gene. In an embodiment, the 5' terminus of the fragment of the second gene is within 10, 20, 30, 40, 50 60, 70, 80, 90, or 100 nucleotides (in either direction) of the 5' terminus provided in FIG. 1A or in Tables E, J, or O for the second gene.

By way of example, for MEX3A and NTRK1 fusion, the 5' terminus can be chromosome 1 (chr1): 156,051,070 to 156,051,319+/−N nucleotides and the 3' terminus can be chr1: 156,843,777 to 156,843,890+/−N nucleotides, wherein N, independently is 10, 20, 30, 40, 50, 60, 70, 80, 90, or 100 nucleotides. In some embodiments, N is 50 nucleotides.

By way of example, for CARM1 and NTRK3 fusion, the 5' terminus can be chromosome 15: 88,799,136 to 88,799,434+/−N nucleotides and the 3' terminus can be chromosome 19: 11,019,501 to 11,019,751+/−N nucleotides, wherein N, independently is 10, 20, 30, 40, 50, 60, 70, 80, 90, or 100 nucleotides. In some embodiments, N is 50 nucleotides.

The fusion nucleic acid molecule need not be between the specific exons found in FIG. 1A or in Tables E, J, or O or in FIG. 1B or in Tables C, H, or M but can be fusions of any exons, e.g., another exon of the first gene to another exon of the second gene, provided that sufficient sequence from the second gene is present to confer kinase activity on an encoded protein and sufficient sequence is present from the first gene to provide for expression of the kinase activity of the second gene in an encoded protein.

In another aspect, methods of producing the fusion nucleic acid molecules and fusion polypeptides, as described herein, are also described.

Nucleic Acid Preparations and Uses Thereof

In another aspect, the disclosure features purified isolated preparations of a tumor nucleic acid, e.g., DNA, e.g., genomic DNA or cDNA, or RNA, containing an interrogation position (e.g., a fusion junction) described herein, useful for determining if an alteration (e.g., a fusion) disclosed herein is present. In some embodiments, the nucleic acid comprises a fusion nucleic acid molecule described herein. The nucleic acid includes the interrogation position, and typically additional nucleotide sequences on one or both sides of the interrogation position. In addition, the nucleic acid can contain a heterologous sequence, e.g., an adaptor, priming, or barcode sequence, typically attached to one or both termini of the nucleic acid. In some embodiments, the nucleic acid also includes a label or other moiety, e.g., a moiety that allows separation (e.g., enrichment) or detection.

In some embodiments, the nucleic acid is between 20 and 1,000, 30 and 900, 40 and 800, 50 and 700, 60 and 600, 70 and 500, 80 and 400, 90 and 300, or 100 and 200 nucleotides (with or without heterologous sequences). In one embodiment, the nucleic acid is between 40 and 1,000, 50 and 900, 60 and 800, 70 and 700, 80 and 600, 90 and 500, 100 and 400, 110 and 300, or 120 and 200 nucleotides (with or without heterologous sequences). In another embodiment, the nucleic acid is between 50 and 1,000, 50 and 900, 50 and 800, 50 and 700, 50 and 600, 50 and 500, 50 and 400, 50 and 300, or 50 and 200 nucleotides (with or without heterologous sequences). In some embodiments, the nucleic acid is of sufficient length to allow sequencing (e.g., by chemical sequencing or by determining a difference in melting temperature ($T_m$) between mutant and reference preparations) but is optionally less than 100, 200, 300, 400, or 500 nucleotides (with or without heterologous sequences).

Such preparations can be used to sequence nucleic acids from a sample, e.g., a sample described herein. In an embodiment, the purified preparation is provided by in situ amplification of a nucleic acid provided on a substrate. In some embodiments, the purified preparation is spatially distinct from other nucleic acids, e.g., other amplified nucleic acids, on a substrate.

In an embodiment, the nucleic acid is derived from a cancer type described herein, e.g., an ovarian cancer (e.g., ovarian carcinosarcoma) or a melanoma (e.g., vaginal melanoma), or a cancer type provided in Tables E, J, or O. In one embodiment, the nucleic acid is derived from an ovarian carcinosarcoma. In one embodiment, the nucleic acid is derived from a vaginal melanoma. In some embodiments, the nucleic acid is derived from any one type of cancer provided in Tables E, J, or O.

In another aspect, the disclosure features, purified or isolated preparations of a fusion nucleic acid, e.g., DNA, e.g., genomic DNA or cDNA, or RNA, containing an interrogation position, e.g., one or both nucleotides flanking a fusion junction, described herein or a mutation, e.g., a rearrangement or fusion junction, described in FIG. 1A or in Tables E, J, or O or in FIG. 1B or in Tables C, H, or M, useful for determining if a mutation disclosed herein is present, disposed in a device for determining a physical or chemical property, e.g., stability of a duplex, e.g., $T_m$ or a sample holder for use in such a device. In an embodiment, the device is a calorimeter. In an embodiment, the fusion nucleic acid molecule is derived from a neoplasm or a tumor of a type described herein, e.g., an ovarian cancer (e.g., ovarian carcinosarcoma) or a melanoma (e.g., a vaginal melanoma).

Such preparations can be used to determine if a sample comprises mutant sequence, e.g., a rearrangement or fusion as described herein. In one embodiment, the rearrangement includes a breakpoint. Nucleic acids that include the aforesaid breakpoint, e.g., a breakpoint described herein, are collectively referred to herein as fusion nucleic acids.

In another aspect, the disclosure features a method of detecting an alteration (e.g., a fusion) described herein, comprising: providing an isolated preparation of a tumor nucleic acid, e.g., DNA, e.g., genomic DNA or cDNA, or RNA, as described herein, containing an interrogation position described herein; and determining the identity of the nucleotide sequence at the interrogation position.

In an embodiment, the detection step comprises sequencing the nucleic acid, e.g., by NGS. In an embodiment, the detection step comprises determining a physical property, e.g., stability (e.g., $T_m$), of the nucleic acid, that distinguishes an alteration from a wildtype sequence.

Detection Reagents

In another aspect, the disclosure features a detection reagent, e.g., an isolated (e.g., purified) preparation thereof. Detection reagents can distinguish a nucleic acid, e.g., a genomic or transcribed nucleic acid, e.g., a cDNA or RNA, or protein sequence, having a breakpoint or fusion junction described herein, e.g., in FIG. 1A or in Tables E, J, or O or in FIG. 1B or in Tables C, H, or M, from a reference nucleotide or amino acid sequence, e.g., a nucleotide or amino acid sequence not having the breakpoint or fusion junction.

In one embodiment, the detection reagent detects (e.g., specifically detects) a fusion nucleic acid molecule described herein, e.g., a fusion nucleic acid molecule encoding a fusion polypeptide described herein. In another embodiment, the detection reagent detects (e.g., specifically detects) a fusion polypeptide described herein, e.g., a fusion polypeptide encoded by a fusion nucleic acid molecule described herein.

Detection reagents, e.g., nucleic acid-based detection reagents, can be used to identify mutations, e.g., rearrangements or fusion junctions described herein, e.g., in FIG. 1A or in Tables E, J, or O or in FIG. 1B or in Tables C, H, or M, in a target nucleic acid, e.g., DNA, e.g., genomic DNA or a transcribed nucleic acid, cDNA, or RNA, e.g., in a sample, e.g., a sample of nucleic acid derived from a neoplastic or tumor cell, e.g., a primary or metastatic cell. In an embodiment, a rearrangement or fusion junction described in FIG. 1A or in Tables E, J, or O or in FIG. 1B or in Tables C, H, or M is detected in a sample of the corresponding cancer listed in FIG. 1A or in Tables E, J or O. Detection reagents, e.g., antibody-based detection reagents, can be used to identify, mutations described herein, e.g., in FIG. 1A or in Tables E, J, or O or in FIG. 1B or in Tables C, H, or M, in a target protein, e.g., in a sample, e.g., a sample of protein derived from, or produced by, a neoplastic or tumor cell, e.g., a primary or metastatic cell.

In some embodiments, the detection reagent distinguishes a nucleotide or amino acid sequence, having a fusion junction, e.g., a MEX3A-NTRK1 fusion junction or a fusion junction described in FIG. 1A or in Tables E, J, or O or in FIG. 1B or in Tables C, H, or M; from a reference nucleotide or amino acid sequence. In one embodiment, the detection reagent detects (e.g., specifically detects) a MEX3A-NTRK1 fusion nucleic acid molecule or polypeptide (e.g., distinguishes a wildtype NTRK1 or another NTRK1 fusion (or a wildtype MEX3A or another MEX3A fusion) from a MEX3A-NTRK1 fusion nucleic acid molecule (e.g., as described herein in FIG. 2 (SEQ ID NO: 1) and FIG. 4 (SEQ ID NO: 3)), respectively, or FIG. 6 (SEQ ID NO: 5)); or a MEX3A-NTRK1 fusion polypeptide (e.g., as described herein in FIG. 3 (SEQ ID NO: 2) and FIG. 5 (SEQ ID NO: 4), respectively, or FIG. 7 (SEQ ID NO: 6)).

In some embodiments, the detection reagent distinguishes a nucleotide or amino acid sequence, having a fusion junction, e.g., a CARM1-NTRK3 fusion junction; from a reference nucleotide or amino acid sequence. In one embodiment, the detection reagent detects (e.g., specifically detects) a CARM1-NTRK3 fusion nucleic acid molecule or polypeptide (e.g., distinguishes a wildtype NTRK3 or another NTRK3 fusion (or a wildtype CARM1 or another MEX3A fusion) from a CARM1-NTRK3 fusion nucleic acid molecule (e.g., as described herein in FIG. 8 (SEQ ID NO: 7) and FIG. 10 (SEQ ID NO: 9)), respectively, or FIG. 12 (SEQ ID NO: 11)); or a CARM1-NTRK3 fusion polypeptide (e.g., as described herein in FIG. 9 (SEQ ID NO: 8) and FIG. 11 (SEQ ID NO: 10), respectively, or FIG. 13 (SEQ ID NO: 11)).

In some embodiments, the detection reagent detects (e.g., specifically detects) a fusion nucleic acid molecule or polypeptide of Tables C, D, E and distinguishes the fusion nucleic acid molecule or polypeptide from a reference nucleotide or amino acid sequence (e.g., a wild type nucleotide or amino acid sequence) of a gene of Table A or Table B or from reference nucleotide or amino acid sequence of NTRK1 (e.g., as shown in FIG. 4 (SEQ ID NO: 3), FIG. 36A (SEQ ID NO: 186), or FIG. 36B (SEQ ID NO: 187) or FIG. 5 (SEQ ID NO: 4), FIG. 36C (SEQ ID NO: 188), or FIG. 36D (SEQ ID NO: 189)). In some embodiments, the detection reagent detects (e.g., specifically detects) a fusion nucleic acid molecule or polypeptide of Tables H, I, J and distinguishes the fusion nucleic acid molecule or polypeptide from a reference nucleotide or amino acid sequence (e.g., a wild type nucleotide or amino acid sequence) of a gene of Table F or Table G or from reference nucleotide or amino acid sequence of NTRK2 (e.g., the nucleotide sequence of SEQ ID NO: 190 or SEQ ID NO: 194 or the amino acid sequence of SEQ ID NO: 191). In some embodiments, the detection reagent detects (e.g., specifically detects) a fusion nucleic acid molecule or polypeptide of Tables M, N, O and distinguishes the fusion nucleic acid molecule or polypeptide from a reference nucleotide or amino acid sequence (e.g., a wild type nucleotide or amino acid sequence) of a gene of Table K or Table I or from reference nucleotide or amino acid sequence of NTRK3 (e.g., as shown in FIG. 10, FIG. 11, or FIGS. 38A-38B).

Detection reagents, e.g., nucleic acid-based detection reagents, can be used to identify mutations (e.g., fusions) in a target nucleic acid, e.g., DNA, e.g., genomic DNA or cDNA, or RNA, e.g., in a sample, e.g., a sample of nucleic acid derived from a neoplasm or a cancer, e.g., an ovarian cancer (e.g., an ovarian carcinosarcoma) or a melanoma (e.g., a vaginal melanoma), or a cancer provided in Tables E, J, or O. Detection reagents, e.g., antibody-based detection reagents, can be used to identify mutations (e.g., fusions) in a target protein, e.g., in a sample, e.g., a sample of protein derived from, or produced by, a neoplasm or a cancer, e.g., an ovarian cancer (e.g., an ovarian carcinosarcoma) or a melanoma (e.g., a vaginal melanoma), or a cancer provided in Tables E, J, or O.

Nucleic Acid-Based Detection Reagents

In an embodiment, the detection reagent comprises a nucleic acid molecule, e.g., a DNA, RNA, or mixed DNA/RNA molecule, comprising a nucleotide sequence, which is complementary to a nucleotide sequence on a target nucleic acid, e.g., a nucleic acid that includes an interrogation position (e.g., a fusion junction). In some instances, the nucleotide sequence on the target nucleic acid that is bound by the detection reagent is referred to herein as the "detection reagent binding site" and the portion of the detection reagent that corresponds to the detection reagent binding site is referred to as the "target binding site." In an embodiment, the detection reagent binding site is disposed in relationship to the interrogation position, e.g., one or both nucleotides flanking a fusion junction, such that binding (or in some embodiments, lack of binding) of the detection reagent to the detection reagent binding site, or the proximity of binding of the detection reagent to the detection binding sites, allows differentiation of mutant and reference sequences for an alteration described herein (e.g., a fusion having a breakpoint or fusion junction described herein, e.g., in FIG. 1A or in Tables E, J, or O or in FIG. 1B or in Tables C, H, or M). The detection reagent can be modified, e.g., with a label or other moiety, e.g., a moiety that allows separation (e.g., capture).

In some embodiments, a mutation described herein, e.g., in FIG. 1A or in Tables E, J, or O or in FIG. 1B or in Tables C, H, or M, is distinguished from a reference sequence by binding or lack of binding of a detection reagent.

In some embodiments, e.g., with proximity-based probes, e.g., FISH probes, a mutation described herein, e.g., in FIG. 1A or in Tables E, J, or O or in FIG. 1B or in Tables C, H, or M, and a reference are distinguished by the proximity of binding of two probes of the detection reagent, e.g., a genomic rearrangement that alters the distance between two binding sites can be detected with proximity-based probes, e.g., FISH probes.

In an embodiment, the detection reagent comprises a nucleic acid molecule, e.g., a DNA, RNA, or mixed DNA/RNA molecule, which, e.g., in its target binding site, includes the interrogation position, e.g., one or more nucleotides that flank a fusion junction, and which can distinguish (e.g., by affinity of binding of the detection reagent to a target nucleic acid, e.g., a genomic or transcribed nucleic acid, e.g., a cDNA or RNA, or the ability for a reaction, e.g., a ligation or extension reaction with the detection reagent) between a mutation, e.g., a fusion molecule described herein, and a reference sequence. In some embodiments, the interrogation position, e.g., one or more nucleotides flanking the fusion junction can correspond to a terminal, e.g., to a 3' or 5' terminal nucleotide, a nucleotide immediately adjacent to a 3' or 5' terminal nucleotide, or to another internal nucleotide, of the detection reagent or target binding site.

In some embodiments, the difference in the affinity of the detection reagent for a target nucleic acid, e.g., a genomic or transcribed nucleic acid, e.g., a cDNA or RNA, comprising the mutant, e.g., a rearrangement or fusion junction, described in FIG. 1A or in Tables E, J, or O or in FIG. 1B or in Tables C, H, or M, and that for a target nucleic acid comprising the reference sequence allows determination of the presence or absence of the mutation (or reference) sequence. Typically, such detection reagents, under assay conditions, can exhibit a substantially higher level of binding only to the mutant or only to the reference sequence.

In some embodiments, binding allows (or inhibits) a subsequent reaction, e.g., a subsequent reaction involving the detection reagent or the target nucleic acid, e.g., binding can allow ligation, or the addition of one or more nucleotides to a nucleic acid, e.g., the detection reagent, e.g., by DNA polymerase, which can be detected and used to distinguish a mutant from reference sequence. In some embodiments, the interrogation position, e.g., one or both nucleotides flanking the fusion junction, is located at a terminus, or sufficiently close to a terminus, of the detection reagent or its target binding site, such that hybridization, or a chemical reaction, e.g., the addition of one or more nucleotides to the detection reagent, e.g., by DNA polymerase, only occurs, or occurs at a substantially higher rate, when there is a perfect match between the detection reagent and the target nucleic acid at the interrogation position, e.g., one or more nucleotides flanking the fusion junction or at a nucleotide position within 1, 2, or 3 nucleotides of the interrogation position, e.g., one or both nucleotides flanking the fusion junction.

In an embodiment, the detection reagent comprises a nucleic acid molecule, e.g., a DNA, RNA, or mixed DNA/RNA molecule, wherein the nucleic acid molecule, or its target binding site, is adjacent (or flanks), e.g., directly adjacent, to the interrogation position, e.g., one or both of the nucleotides that flank a fusion junction, and which can distinguish between a mutation, e.g., a mutant, e.g., a rearrangement or fusion junction, described in FIG. 1A or in Tables E, J, or O or in FIG. 1B or in Tables C, H, or M, and a reference sequence, in a target nucleic acid, e.g., a genomic or transcribed nucleic acid, e.g., a cDNA or RNA.

In some embodiments, the detection reagent binding site is adjacent to the interrogation position, e.g., one or both nucleotides flanking the fusion junction, e.g., the 5' or 3' terminal nucleotide of the detection reagent, or its target binding site, is adjacent, e.g., between 0 (directly adjacent) and 1,000, 500, 400, 200, 100, 50, 10, 5, 4, 3, 2, or 1 nucleotides from the interrogation position, e.g., one or both nucleotides flanking the fusion junction.

In some embodiments, the outcome of a reaction varies with the identity of the nucleotide at the interrogation position, e.g., one or both nucleotides flanking the fusion junction, allowing one to distinguish between mutant and reference sequences, e.g., in the presence of a first nucleotide at the interrogation position, e.g., one or both nucleotides flanking the fusion junction, a first reaction is favored over a second reaction. In some embodiments, in a ligation or primer extension reaction, the product differs, e.g., in charge, sequence, size, or susceptibility to a further reaction (e.g., restriction cleavage) depending on the identity of the nucleotide at the interrogation position, e.g., one or both nucleotides flanking the fusion junction. In some embodiments, the detection reagent comprises paired molecules (e.g., forward and reverse primers), allowing for amplification, e.g., by PCR amplification, of a nucleic acid molecule containing the interrogation position, e.g., one or both nucleotides flanking the fusion junction. In such embodiments, the presence of the mutation can be determined by a difference in the property of the amplification product, e.g., size, sequence, charge, or susceptibility to a reaction, resulting from a sequence comprising the interrogation position, e.g., one or both nucleotides flanking the fusion junction, and a corresponding sequence having a reference nucleotide at the interrogation position, e.g., one or both nucleotides flanking the fusion junctions. In some embodiments, the presence or absence of a characteristic amplification product is indicative of the identity of the nucleotide at the interrogation site and thus allows detection of the mutation.

In some embodiments, the detection reagent, or its target binding site, is directly adjacent to the interrogation position, e.g., one or both nucleotides flanking the fusion junction, e.g., the 5' or 3' terminal nucleotide of the detection reagent is directly adjacent to the interrogation position, e.g., one or both nucleotides flanking the fusion junction. In some embodiments, the identity of the nucleotide at the interrogation position, e.g., one or both nucleotides flanking the fusion junction, will determine the nature of a reaction, e.g., a reaction involving the detection reagent, e.g., the modification of one end of the detection reagent, e.g., in the presence of a first nucleotide at the interrogation position, e.g., one or both nucleotides flanking the fusion junction, a first reaction will be favored over a second reaction. By way of example, the presence of a first nucleotide at the interrogation position, e.g., one or both nucleotides flanking the fusion junction, e.g., a nucleotide associated with a mutation, can promote a first reaction, e.g., the addition of a complementary nucleotide to the detection reagent. By way of example, the presence of an A at the interrogation position, e.g., one or both nucleotides flanking the fusion junction, will cause the incorporation of a T, having, e.g., a first colorimetric label, while the presence of a G at the interrogation position, e.g., one or both nucleotides flanking the fusion junction, will cause the incorporation of a C, e.g., having a second colorimetric label. In an embodiment, the presence of a first nucleotide at the interrogation position will result in ligation of the detection reagent to a second nucleic acid. In an embodiment, a third nucleic acid can be hybridized to the target nucleic acid sufficiently close to the interrogation site such that if the third nucleic acid has an exact match at the interrogation site, it will be ligated to the detection reagent. Detection of the ligation product, or its absence, is indicative of the identity of the nucleotide at the interrogation site and thus allows detection of the mutation.

A variety of readouts can be employed, e.g., binding of the detection reagent to the mutant or reference sequence can be followed by binding of a moiety, e.g., a label, associated with the detection reagent, e.g., a radioactive or enzymatic label. In some embodiments, the label comprises a quenching agent and a signaling agent and hybridization results in altering the distance between those two agents, e.g., increasing the distance and un-quenching the signaling agent. In some embodiments, the detection reagent includes a moiety that allows separation from other components of a reaction mixture. In some embodiments, binding allows cleavage of the bound detection reagent, e.g., by an enzyme, e.g., by the nuclease activity of a DNA polymerase or by a restriction enzyme. The cleavage can be detected by the appearance or disappearance of a nucleic acid or by the separation of a quenching agent and a signaling agent associated with the detection reagent. In some embodiments, binding protects, or renders the target susceptible, to further chemical reaction, e.g., labeling or degradation, e.g., by restriction enzymes. In some embodiments, binding with the detection reagent allows capture, separation, or physical manipulation of the target nucleic acid to thereby allow for identification of a fusion nucleic acid molecule described herein. In some embodiments, binding results in a detect localization of the detection reagent or target, e.g., binding could capture the target nucleic acid or displace a third nucleic acid. In some embodiments, binding allows for determination of the presence of mutant or reference sequences with FISH, particularly in the case of rearrangements. In some embodiments, binding allows for the extension or other size change in a component, e.g., the detection reagent, allowing distinction between mutant and reference sequences. In some embodiments, binding allows for the production, e.g., by PCR, of an amplicon that distinguishes a mutant sequence from a reference sequence.

In an embodiment, the detection reagent, or the target binding site, is between 5 and 2000, 5 and 1000, 5 and 500, 5 and 300, 5 and 250, 5 and 200, 5 and 150, 5 and 100, 5 and 50, 5 and 25, 5 and 20, 5 and 15, or 5 and 10 nucleotides. In an embodiment, the detection reagent, or the target binding site, is between 10 and 2000, 10 and 1000, 10 and 500, 10 and 300, 10 and 250, 10 and 200, 10 and 150, 10 and 100, 10 and 50, 10 and 25, 10 and 20, or 10 and 15, nucleotides. In an embodiment, the detection reagent, or the target binding site, is between 20 and 2000, 20 and 1000, 20 and 500, 20 and 300, 20 and 250, 20 and 200, 20 and 150, 20 and 100, 20 and 50, or 20 and 25 nucleotides. In an embodiment, the detection reagent, or the target binding site, is sufficiently long to distinguish between mutant and reference sequences and is less than 100, 200, 300, 400, 500, 1,000, 1,500, or 2,000 nucleotides.

In some embodiments, the detection reagent comprises two probes which can bind with a first proximity to one another if a mutation described herein, e.g., a rearrangement or fusion junction, described in FIG. 1A or in Tables E, J, or O or in FIG. 1B or in Tables C, H, or M, is present and with a second proximity to one another if the mutation is not present. Typically, one of the proximities will result in production of a signal and the other will not. One probe can comprise a signal generator and the other can comprise a signal quencher. If the proximity is close, there will be no signal and if the proximity is less, then signal will be produced.

A mutation (e.g., a rearrangement, e.g., a fusion) described herein can be distinguished from a reference, e.g., a non-mutant or wildtype sequence, by reaction with an enzyme that reacts differentially with the mutation and the reference, e.g., distinguished by cleavage with a restriction enzyme that has differing activity for the mutant and reference. The disclosure includes a method of contacting a nucleic acid comprising a mutation described herein with such an enzyme and determining if a product of that cleavage which can distinguish mutant from reference sequence is present.

In one aspect, the disclosure provides a purified preparation of a restriction enzyme cleavage product which can distinguish between mutant and reference sequence, wherein one end of the cleavage product is defined by an enzyme that cleaves differentially between mutant and reference sequence. In an embodiment, the cleavage product includes the interrogation position, e.g., one or both nucleotides flanking the fusion junction.

Probes

The disclosure also provides nucleic acid molecules useful as probes. Such nucleic acid probes can be designed based on the nucleotide sequence of a fusion nucleic acid molecule described herein.

Probes based on the sequence of a fusion nucleic acid molecule as described herein can be used to detect transcripts or genomic sequences corresponding to one or more fusion nucleic acid molecules featured in the disclosure. The probe typically comprises a label group attached thereto, e.g., a radioisotope, a fluorescent compound, an enzyme, or an enzyme co-factor. Such probes can be used as part of a test kit for identifying cells or tissues which express the fusion protein (e.g., a fusion molecule described herein), such as by measuring levels of a nucleic acid molecule encoding the protein in a sample of cells from a subject, e.g., detecting mRNA levels or determining whether a gene encoding the protein has been mutated or deleted.

Probes featured in the disclosure include those that will specifically hybridize to a nucleotide sequence described herein. Typically, these probes are 12 to 20, e.g., 17 to 20 nucleotides (longer for large insertions). Such molecules can be labeled according to any technique known in the art, such as with radiolabels, fluorescent labels, enzymatic labels, sequence tags, biotin, or other ligands. As used herein, a probe that "specifically hybridizes" to a fusion gene sequence will hybridize under high stringency conditions.

A probe can typically contain a specific mutated sequence (or a complementary sequence thereof) described herein. Typically, a nucleic acid probe will encompass only one mutation. Such molecules may be labeled and can be used as allele-specific probes to detect the mutation of interest.

In some embodiments, the probe specifically hybridizes to a nucleic acid comprising an inversion resulting in a fusion nucleic acid molecule. In other embodiments, the probe specifically hybridizes to a nucleic acid comprising an inversion resulting in a fusion nucleic acid molecule. In other embodiments, the probe specifically hybridizes to a nucleic acid comprising a deletion resulting in a fusion nucleic acid molecule.

Isolated pairs of allele specific oligonucleotide probes are also provided, where the first probe of the pair specifically hybridizes to the mutant allele, and the second probe of the pair specifically hybridizes to the wildtype allele. Probe pairs can be designed and produced for any of the fusion nucleic acid molecules described herein and are useful in detecting a somatic mutation in a sample.

For example, in one exemplary probe pair, one probe will recognize the fusion junction in the MEX3A-NTRK1 fusion nucleic acid molecule, and the other probe will recognize a sequence downstream or upstream of MEX3A or NTRK1, neither of which includes the fusion junction. These allele-specific probes are useful in detecting NTRK1 mutations or MEX3A mutations in a sample, e.g., somatic mutations, e.g., in an ovarian carcinosarcoma.

For example, in another exemplary probe pair, one probe will recognize the fusion junction in the CARM1-NTRK3 fusion, and the other probe will recognize a sequence downstream or upstream of CARM1 or NTRK3, neither of which includes the fusion junction. These allele-specific probes are useful in detecting NTRK3 mutations or CARM1 mutations in a sample, in detecting NTRK1 mutations or MEX3A mutations in a sample, e.g., in a vaginal melanoma.

For example, in other exemplary probe pairs, one probe will recognize the fusion junction in an NTRK1 fusion with a gene of Table A (e.g., a fusion junction provided in Table C or Table E), and the other probe will recognize a sequence downstream or upstream of NTRK1 or the gene of Table A, neither of which includes the fusion junction. These allele-specific probes are useful in detecting NTRK1 mutations or mutations in a gene of Table A in a sample, e.g., somatic mutations, e.g., in a cancer provided in Table E.

For example, in other exemplary probe pairs, one probe will recognize the fusion junction in an NTRK2 fusion with a gene of Table F (e.g., a fusion junction provided in Table H or Table J), and the other probe will recognize a sequence downstream or upstream of NTRK2 or the gene of Table F, neither of which includes the fusion junction. These allele-specific probes are useful in detecting NTRK2 mutations or mutations in a gene of Table F in a sample, e.g., somatic mutations, e.g., in a cancer provided in Table J.

For example, in other exemplary probe pairs, one probe will recognize the fusion junction in an NTRK3 fusion with a gene of Table K (e.g., a fusion junction provided in Table M or Table O), and the other probe will recognize a sequence downstream or upstream of NTRK3 or the gene of Table K, neither of which includes the fusion junction. These allele-specific probes are useful in detecting NTRK3 mutations or mutations in a gene of Table K in a sample, e.g., somatic mutations, e.g., in a cancer provided in Table O.

Primers

The disclosure also provides nucleic acid molecules useful as primers. Such nucleic acid primers can be designed based on the nucleotide sequence of a fusion nucleic acid molecule described herein.

The term "primer" as used herein refers to a sequence comprising two or more deoxyribonucleotides or ribonucleotides, e.g., more than three, and more than eight, or at least 20 nucleotides of a gene described in any of FIGS. 1A-1C or in Tables A, F, or K, where the sequence corresponds to a sequence flanking one of the mutations or a wildtype sequence of a gene identified in FIGS. 1A-1C or in Tables A, F, or K, e.g., any gene described herein involved in a fusion molecule described herein. Primers may be used to initiate DNA synthesis via PCR (polymerase chain reaction) or a sequencing method. Primers featured in the disclosure include the sequences recited and complementary sequences which can anneal to the opposite DNA strand of the sample target. Since both strands of DNA are complementary and mirror images of each other, the same segment of DNA will be amplified.

Primers can be used to sequence a nucleic acid, e.g., a fusion nucleic acid molecule described herein, such as by an NGS method, or to amplify a nucleic acid, e.g., a fusion nucleic acid molecule described herein, such as by PCR. The primers can specifically hybridize, for example, to the ends of the exons or to the introns flanking the exons. The amplified segment can then be further analyzed for the presence of a mutation such as by a sequencing method. The primers are useful in directing amplification of a target polynucleotide prior to sequencing. In another aspect, the disclosure features a pair of oligonucleotide primers that amplify a region that contains or is adjacent to a fusion junction described in FIG. 1A-1C, or in Tables C, E, H, J, M, or O. Such primers are useful in directing amplification of a target region that includes a fusion junction described in FIG. 1A-1C or in Tables C, E, H, J, M, or O, e.g., prior to sequencing. A primer typically contains 12 to 20, or 17 to 20, or more nucleotides, although a primer may contain fewer nucleotides.

A primer is typically single stranded, e.g., for use in sequencing or amplification methods, but may be double stranded. If double stranded, the primer may first be treated to separate its strands before being used to prepare extension products. A primer must be sufficiently long to prime the synthesis of extension products in the presence of the inducing agent for polymerization. The exact length of primer will depend on many factors, including applications (e.g., amplification method), temperature, buffer, and nucleotide composition.

Primers are typically designed to be "substantially" complementary to each strand of a genomic locus to be amplified. Thus, the primers must be sufficiently complementary to specifically hybridize with their respective strands under conditions which allow the agent for polymerization to perform. In other words, the primers should have sufficient complementarity with the 5' and 3' sequences flanking the mutation to hybridize therewith and permit amplification of the genomic locus.

The term "substantially complementary to" or "substantially the sequence" refers to sequences that hybridize to the sequences provided under stringent conditions and/or sequences having sufficient homology with a sequence comprising a fusion junction identified in the Example, or the wildtype counterpart sequence, such that the allele specific oligonucleotides hybridize to the sequence. In one embodiment, a sequence is substantially complementary to a fusion junction in an inversion event, e.g., to a fusion junction in any fusion molecule described herein. "Substantially the same" as it refers to oligonucleotide sequences also refers to the functional ability to hybridize or anneal with sufficient specificity to distinguish between the presence or absence of the mutation. This is measurable by the temperature of melting being sufficiently different to permit easy identification of whether the oligonucleotide is binding to the normal or mutant gene sequence identified in the Example.

In one aspect, the disclosure features a primer or primer set for amplifying a nucleic acid comprising an inversion resulting in a fusion molecule described herein. In another aspect, the disclosure features a primer or primer set for amplifying a nucleic acid comprising an inversion resulting in fusion molecule described herein. In another aspect, the disclosure features a primer or primer set for amplifying a nucleic acid comprising a deletion resulting in fusion molecule described herein. In another aspect, the disclosure features a primer or primer set for amplifying a nucleic acid comprising a translocation resulting in fusion molecule described herein.

Isolated pairs of allele specific oligonucleotide primers are also provided, where the first primer of a pair specifically hybridizes to the mutant allele, and the second primer of a pair specifically hybridizes to a sequence upstream or downstream of a mutation, or a fusion junction resulting from, e.g., an inversion, duplication, deletion, insertion or translocation.

In one exemplary primer pair, one probe will recognize a MEX3A-NTRK1 fusion nucleic acid molecule, such as by hybridizing to a sequence at the fusion junction between the MEX3A and NTRK1 transcripts or genomic sequences, and the other primer will recognize a sequence upstream or downstream of the fusion junction. These allele-specific primers are useful for amplifying a MEX3A-NTRK1 fusion nucleic acid molecule from a sample, e.g., a sample from an ovarian cancer, e.g., an ovarian carcinosarcoma.

In another exemplary primer pair, one probe will recognize a CARM1-NTRK3 fusion, such as by hybridizing to a sequence at the fusion junction between the CARM1 and NTRK3 transcripts or genomic sequences, and the other primer will recognize a sequence upstream or downstream of the fusion junction. These allele-specific primers are useful for amplifying a CARM1-NTRK3 fusion sequence from a tumor sample, e.g., a sample from a suspected melanoma, e.g., a vaginal melanoma.

In other exemplary primer pairs, one probe will recognize an NTRK1 fusion nucleic acid molecule, e.g., provided in Table C, such as by hybridizing to a sequence at the fusion junction between the NTRK1 transcripts or genomic sequences and the transcripts or genomic sequences of a gene of Table A (e.g., a fusion junction provided in Tables C or E), and the other primer will recognize a sequence upstream or downstream of the fusion junction. These allele-specific primers are useful for amplifying an NTRK1 fusion nucleic acid molecules from a sample, e.g., a sample from a cancer provided in Table E.

In other exemplary primer pairs, one probe will recognize an NTRK2 fusion nucleic acid molecule, e.g., provided in Table H, such as by hybridizing to a sequence at the fusion junction between the NTRK2 transcripts or genomic sequences and the transcripts or genomic sequences of a gene of Table F (e.g., a fusion junction provided in Tables H or J), and the other primer will recognize a sequence upstream or downstream of the fusion junction. These allele-specific primers are useful for amplifying an NTRK2 fusion nucleic acid molecules from a sample, e.g., a sample from a cancer provided in Table J.

In other exemplary primer pairs, one probe will recognize an NTRK3 fusion nucleic acid molecule, e.g., provided in Table M, such as by hybridizing to a sequence at the fusion junction between the NTRK3 transcripts or genomic sequences and the transcripts or genomic sequences of a gene of Table K (e.g., a fusion junction provided in Tables M or O), and the other primer will recognize a sequence upstream or downstream of the fusion junction. These allele-specific primers are useful for amplifying an NTRK3 fusion nucleic acid molecules from a sample, e.g., a sample from a cancer provided in Table O.

In another exemplary primer pair, one primer can recognize a MEX3A-NTRK1 fusion nucleic acid molecule, such as by hybridizing to a sequence at the fusion junction between the MEX3A and NTRK1 transcripts, and the other primer will recognize a sequence upstream or downstream of the fusion junction. These allele-specific primers are useful for amplifying a MEX3A-NTRK1 fusion nucleic acid molecule from a sample, e.g., a sample from an ovarian carcinosarcoma.

In another exemplary primer pair, one primer can recognize a CARM1-NTRK3 fusion nucleic acid molecule, such as by hybridizing to a sequence at the fusion junction between the CARM1 and NTRK3 transcripts, and the other primer will recognize a sequence upstream or downstream of the fusion junction. These allele-specific primers are useful for amplifying a CARM1-NTRK3 fusion sequence from a sample, e.g., a sample from a vaginal melanoma.

In other exemplary primer pairs, one primer can recognize an NTRK1 fusion nucleic acid molecule, such as by hybridizing to a sequence at the fusion junction between the NTRK1 transcripts and a transcript of a gene of Table A (e.g., a fusion junction provided in Tables C or E), and the other primer will recognize a sequence upstream or downstream of the fusion junction. These allele-specific primers are useful for amplifying an NTRK1 fusion nucleic acid molecule from a sample, e.g., a sample from a cancer provided in Table E.

In other exemplary primer pairs, one primer can recognize an NTRK2 fusion nucleic acid molecule, such as by hybridizing to a sequence at the fusion junction between the NTRK2 transcripts and a transcript of a gene of Table F (e.g., a fusion junction provided in Tables H or J), and the other primer will recognize a sequence upstream or downstream of the fusion junction. These allele-specific primers are useful for amplifying an NTRK2 fusion nucleic acid molecule from a sample, e.g., a sample from a cancer provided in Table J.

In other exemplary primer pairs, one primer can recognize an NTRK3 fusion nucleic acid molecule, such as by hybridizing to a sequence at the fusion junction between the NTRK3 transcripts and a transcript of a gene of Table K (e.g., a fusion junction provided in Tables M or O), and the other primer will recognize a sequence upstream or downstream of the fusion junction. These allele-specific primers are useful for amplifying an NTRK3 fusion nucleic acid molecule from a sample, e.g., a sample from a cancer provided in Table O.

Primers can be prepared using any suitable method, such as conventional phosphotriester and phosphodiester methods or automated embodiments thereof. In one such automated embodiment, diethylphosphoramidites are used as starting materials and may be synthesized as described by Beaucage, et al. (1981) Tetrahedron Letters, 22:1859-1862. One method for synthesizing oligonucleotides on a modified solid support is described in U.S. Pat. No. 4,458,066.

An oligonucleotide probe or primer that hybridizes to a mutant or wildtype allele is said to be the complement of the allele. As used herein, a probe exhibits “complete complementarity” when every nucleotide of the probe is complementary to the corresponding nucleotide of the allele. Two polynucleotides are said to be “minimally complementary” if they can hybridize to one another with sufficient stability to permit them to remain annealed to one another under at least conventional “low-stringency” conditions. Similarly, the polynucleotides are said to be “complementary” if they can hybridize to one another with sufficient stability to permit them to remain annealed to one another under conventional "high-stringency" conditions. Conventional stringency conditions are known to those skilled in the art and can be found, for example in *Molecular Cloning: A Laboratory Manual,* 3rd edition Volumes 1, 2, and 3. J. F. Sambrook, D. W. Russell, and N. Irwin, Cold Spring Harbor Laboratory Press, 2000.

Departures from complete complementarity are therefore permissible, as long as such departures do not completely preclude the capacity of a probe to hybridize to an allele. Thus, in order for a polynucleotide to serve as a primer or probe it need only be sufficiently complementary in sequence to be able to form a stable double-stranded structure under the particular solvent and salt concentrations employed. Appropriate stringency conditions which promote DNA hybridization are, for example, 6.0× sodium chloride/sodium citrate (SSC) at about 45° C., followed by a wash of 2.0×SSC at 50° C. Such conditions are known to those skilled in the art and can be found, for example in *Current Protocols in Molecular Biology*, John Wiley & Sons, N.Y. (1989). Salt concentration and temperature in the wash step can be adjusted to alter hybridization stringency. For example, conditions may vary from low stringency of about 2.0×SSC at 40° C. to moderately stringent conditions of about 2.0×SSC at 50° C. to high stringency conditions of about 0.2×SSC at 50° C.

Reaction Mixtures and Devices

In another aspect, the disclosure features a reaction mixture comprising: a) a nucleic acid (e.g., DNA, e.g., genomic DNA or cDNA, or RNA) from a cancer, or a sample comprising the nucleic acid, wherein the nucleic acid comprises a mutation or an interrogation position for the mutation, e.g., a rearrangement or fusion junction described in FIG. 1A or in Tables E, J, or O or in FIG. 1B or in Tables C, H, or M; and b) a detection reagent that detects the mutation or the interrogation position, e.g., a detection reagent described herein.

In an embodiment, the cancer is an ovarian cancer (e.g., ovarian carcinosarcoma) or a melanoma (e.g., a vaginal melanoma). In some embodiments, the cancer is a cancer provided in Tables E, J, or O.

In an embodiment, the nucleic acid or sample is from a cancer listed in FIG. 1A, and the detection reagent detects a rearrangement or fusion junction disclosed in FIG. 1A or 1B. In some embodiments, the nucleic acid or sample is from a cancer listed in Table E, and the detection reagent detects a rearrangement or fusion junction disclosed in Tables C or E. In some embodiments, the nucleic acid or sample is from a cancer listed in Table J, and the detection reagent detects a rearrangement or fusion junction disclosed in Tables H or J. In some embodiments, the nucleic acid or sample is from a cancer listed in Table O, and the detection reagent detects a rearrangement or fusion junction disclosed in Tables M or O.

In an embodiment, the nucleic acid or sample is from an ovarian cancer (e.g., ovarian carcinosarcoma), and the detection reagent is one that detects a fusion of the MEX3A and NTRK1 genes, e.g., a detection reagent that detects a rearrangement or breakpoint described in FIG. 1A, 1B or 1C for a fusion of the MEX3A and NTRK1 genes.

In an embodiment, the nucleic acid or sample is from a melanoma (e.g., a vaginal melanoma), and the detection reagent is one that detects a fusion of the CARM1 and NTRK3 genes, e.g., a detection reagent that detects a rearrangement or fusion junction described in FIG. 1A, 1B, or 1C for a fusion of CARM1 and NTRK3.

In some embodiments, the nucleic acid or sample is from a cancer provided in Table E, and the detection reagent is one that detects a fusion of the NTRK1 gene and a gene of Table A, e.g., a detection reagent that detects a rearrangement or breakpoint described in Tables C or E.

In some embodiments, the nucleic acid or sample is from a cancer provided in Table J, and the detection reagent is one that detects a fusion of the NTRK2 gene and a gene of Table F, e.g., a detection reagent that detects a rearrangement or breakpoint described in Tables H or J.

In some embodiments, the nucleic acid or sample is from a cancer provided in Table O, and the detection reagent is one that detects a fusion of the NTRK3 gene and a gene of Table K, e.g., a detection reagent that detects a rearrangement or breakpoint described in Tables M or O.

In some embodiments, the reaction mixture comprises an isolated (e.g., purified) preparation of a fusion nucleic acid, e.g., DNA, e.g., genomic DNA or cDNA, or RNA, containing an interrogation position, e.g., one or both nucleotides flanking the fusion junction, described herein or a mutation, e.g., a rearrangement or fusion junction, described in FIG. 1A, 1B, or 1C or in Tables C, E, H, J, M, or O. In some embodiments, the preparation is useful for determining if a mutation disclosed herein is present. In some embodiments, the preparation is disposed in a device, e.g., a sequencing device, or a sample holder for use in such a device. In an embodiment, the fusion nucleic acid is derived from a neoplasm or a tumor of a type described herein, e.g., an ovarian cancer (e.g., ovarian carcinosarcoma) or a melanoma (e.g., a vaginal melanoma), or a cancer provided in Tables E, J, or O. In an embodiment, the nucleic acid is from an ovarian cancer (e.g., ovarian carcinosarcoma). In an embodiment, the nucleic acid is from a melanoma (e.g., a vaginal melanoma).

In an embodiment, the nucleic acid is from a cancer (e.g., an ovarian cancer (e.g., ovarian carcinosarcoma) or a melanoma (e.g., a vaginal melanoma)), and the device includes a detection reagent that detects a fusion nucleic acid molecule associated with the cancer, e.g., a detection reagent that detects a mutant, e.g., a rearrangement or fusion junction described in FIG. 1A, 1B, or 1C.

In an embodiment, the nucleic acid is from a cancer provided in Table E, and the device includes a detection reagent that detects a fusion nucleic acid molecule associated with the cancer, e.g., a detection reagent that detects a mutant, e.g., a rearrangement or fusion junction described in Tables C or E.

In an embodiment, the nucleic acid is from a cancer provided in Table J, and the device includes a detection reagent that detects a fusion nucleic acid molecule associated with the cancer, e.g., a detection reagent that detects a mutant, e.g., a rearrangement or fusion junction described in Tables H or J.

In an embodiment, the nucleic acid is from a cancer provided in Table O, and the device includes a detection reagent that detects a fusion nucleic acid molecule associated with the cancer, e.g., a detection reagent that detects a mutant, e.g., a rearrangement or fusion junction described in Tables M or O.

In another aspect, the disclosure features a method of making a reaction mixture by combining: a) a nucleic acid (e.g., DNA, e.g., genomic DNA or cDNA, or RNA) from a cancer, or a sample comprising the nucleic acid, wherein the nucleic acid comprises a mutation or an interrogation position for the mutation, e.g., a rearrangement or fusion junction described in FIG. 1A or in Tables E, J, or O or in FIG. 1B or in Tables C, H, or M; with b) a detection reagent that detects the mutation or the interrogation position, e.g., a detection reagent described herein.

Fusion Polypeptides

One aspect featured in the disclosure pertains to isolated (e.g., purified) fusion polypeptides and biologically active portions thereof. The fusion polypeptide can be a polypeptide encoded by any fusion nucleic acid molecule described herein. In one embodiment, the fusion polypeptide is isolated from cells or tissue sources by an appropriate purification scheme using standard protein purification techniques. In another embodiment, the fusion polypeptide is produced by recombinant DNA techniques. As an alternative to recombinant expression, a fusion polypeptide described herein can be synthesized chemically using standard peptide synthesis techniques.

An "isolated" or "purified" protein or biologically active portion thereof is substantially free of cellular material or other contaminating proteins from the cell or tissue source from which the protein is derived, or substantially free of chemical precursors or other chemicals when chemically synthesized. The language "substantially free of cellular material" includes preparations of protein in which the protein is separated from cellular components of the cells from which it is isolated or recombinantly produced. Thus, protein that is substantially free of cellular material includes preparations of protein having less than about 30%, less than about 20%, less than about 10%, or less than about 5% (by dry weight) of heterologous protein (also referred to herein as a "contaminating protein"). When the protein or biologically active portion thereof is recombinantly produced, it can be substantially free of culture medium, i.e., culture medium represents less than about 20%, less than about 10%, or less than about 5% of the volume of the protein preparation. When the protein is produced by chemical synthesis, it can be substantially free of chemical precursors or other chemicals, i.e., it is separated from chemical precursors or other chemicals which are involved in the synthesis of the protein. Accordingly, such preparations of the protein have less than about 30%, less than about 20%, less than about 10%, less than about 5% (by dry weight) of chemical precursors or compounds that are not the polypeptide of interest.

Biologically active portions of a fusion polypeptide include polypeptides comprising amino acid sequences sufficiently identical to or derived from the amino acid sequence of the fusion polypeptide, which include fewer amino acids than the full length protein, and that exhibit at least one activity of the corresponding full-length protein, e.g., a kinase activity e.g., an NTRK1, NTRK2, or NTRK3 kinase activity, e.g., a TRKA, TRKB, or TRKC kinase activity. A biologically active portion of a protein featured in the disclosure can be a polypeptide which is, for example, 10, 25, 50, 100 or more amino acids. Moreover, other biologically active portions, in which other regions of the protein are deleted, can be prepared by recombinant techniques and evaluated for one or more of the functional activities of the wildtype form of a polypeptide.

In certain embodiments, the fusion polypeptide has an amino acid sequence of a protein encoded by a nucleic acid molecule disclosed herein. Other useful proteins are substantially identical (e.g., at least 60, at least 65, at least 70, at least 75, at least 80, at least 85, at least 86, at least 87, at least 88, at least 89, at least 90, at least 91, at least 92, at least 93, at least 94, at least 95, at least 96, at least 97, at least 98, at least 99, at least 99.5% or greater) to one of these sequences and retain the functional activity of the protein of the corresponding full-length protein yet differ in amino acid sequence.

A fusion polypeptide molecule (e.g., an isolated fusion polypeptide molecule) described herein, or a fragment thereof, can be used as an immunogen to generate antibodies using standard techniques for polyclonal and monoclonal antibody preparation. The full-length fusion polypeptide can be used or, alternatively, the disclosure provides antigenic peptide fragments for use as immunogens. The antigenic peptide of a protein featured in the disclosure comprises at least 8 (or at least 10, at least 15, at least 20, or at least 30 or more) amino acid residues of the amino acid sequence of one of the polypeptides featured in the disclosure, and encompasses an epitope of the protein such that an antibody raised against the peptide forms a specific immune complex with a fusion polypeptide featured in the disclosure to which the protein corresponds. Exemplary epitopes encompassed by the antigenic peptide are regions that are located on the surface of the protein, e.g., hydrophilic regions. Hydrophobicity sequence analysis, hydrophilicity sequence analysis, or similar analyses can be used to identify hydrophilic regions.

An immunogen typically is used to prepare antibodies by immunizing a suitable (i.e., immunocompetent) subject such as a rabbit, goat, mouse, or other mammal or vertebrate. An appropriate immunogenic preparation can contain, for example, recombinantly-expressed or chemically-synthesized polypeptide. The preparation can further include an adjuvant, such as Freund's complete or incomplete adjuvant, or a similar immunostimulatory agent.

Accordingly, another aspect featured in the disclosure pertains to antibodies directed against a fusion polypeptide described herein. In one embodiment, the antibody molecule specifically binds to a fusion polypeptide described herein, e.g., specifically binds to an epitope formed by the fusion polypeptide. In some embodiments the antibody can distinguish wildtype gene products that make up the fusion polypeptide from the fusion polypeptide, e.g., the antibody can distinguish wildtype gene products, e.g., (a) one or both of MEX3A or NTRK1 from MEX3A-NTRK1 or (b) one or both of CARM1 or NTRK3 from CARM1-NTRK3, (c) or one or both of NTRK1 or a polypeptide of Table B from a fusion polypeptide of Table D, (d) or one or both of NTRK2 or a polypeptide of Table G from a fusion polypeptide of Table I, (e) or one or both of NTRK3 or a polypeptide of Table L from a fusion polypeptide of Table N.

The terms "antibody" and "antibody molecule" as used interchangeably herein refer to immunoglobulin molecules and immunologically active portions of immunoglobulin molecules, i.e., molecules that contain an antigen binding site which specifically binds an antigen, such as a polypeptide featured in the disclosure. A molecule which specifically binds to a given polypeptide featured in the disclosure is a molecule which binds the polypeptide, but does not substantially bind other molecules in a sample, e.g., a biological sample, which contains the polypeptide. Examples of immunologically active portions of immunoglobulin molecules include F(ab) and $F(ab')_2$ fragments which can be generated by treating the antibody with an enzyme such as pepsin. The disclosure provides polyclonal and monoclonal antibodies. The term "monoclonal antibody" or "monoclonal antibody composition," as used herein, refers to a population of antibody molecules that contain only one species of an antigen binding site capable of immunoreacting with a particular epitope.

Polyclonal antibodies can be prepared as described above by immunizing a suitable subject with a fusion polypeptide as an immunogen. Antibody-producing cells can be obtained from the subject and used to prepare monoclonal antibodies by standard techniques, such as the hybridoma technique originally described by Kohler and Milstein (1975) *Nature* 256:495-497, the human B cell hybridoma technique (see Kozbor et al., 1983, *Immunol. Today* 4:72), the EBV-hybridoma technique (see Cole et al., pp. 77-96 In *Monoclonal Antibodies and Cancer Therapy, Alan R. Liss, Inc.,* 1985) or trioma techniques. The technology for producing hybridomas is well known (see generally *Current Protocols in Immunology*, Coligan et al. ed., John Wiley & Sons, New York, 1994). Hybridoma cells producing a monoclonal antibody are detected by screening the hybridoma culture supernatants for antibodies that bind the polypeptide of interest, e.g., using a standard ELISA assay.

As an alternative to preparing monoclonal antibody-secreting hybridomas, a monoclonal antibody can be identified and isolated by screening a recombinant combinatorial immunoglobulin library (e.g., an antibody phage display library) with the polypeptide of interest. Kits for generating and screening phage display libraries are commercially available (e.g., the *Pharmacia Recombinant Phage Antibody System*, Catalog No. 27-9400-01; and the Stratagene SurfZAP Phage Display Kit, Catalog No. 240612). Additionally, examples of methods and reagents particularly amenable for use in generating and screening antibody display library can be found in, for example, U.S. Pat. No. 5,223,409; PCT Publication No. WO 92/18619; PCT Publication No. WO 91/17271; PCT Publication No. WO 92/20791; PCT Publication No. WO 92/15679; PCT Publication No. WO 93/01288; PCT Publication No. WO 92/01047; PCT Publication No. WO 92/09690; PCT Publication No. WO 90/02809; Fuchs et al. (1991) *Bio/Technology* 9:1370-1372; Hay et al. (1992) *Hum. Antibod. Hybridomas* 3:81-85; Huse et al. (1989) *Science* 246:1275-1281; and Griffiths et al. (1993) *EMBO J.* 12:725-734.

Additionally, recombinant antibodies, such as chimeric and humanized monoclonal antibodies, comprising both human and non-human portions can be made using standard recombinant DNA techniques. Such chimeric and humanized monoclonal antibodies can be produced by recombinant DNA techniques known in the art, for example using methods described in PCT Publication No. WO 87/02671; European Patent Application 184,187; European Patent Application 171,496; European Patent Application 173,494; PCT Publication No. WO 86/01533; U.S. Pat. No. 4,816,567; European Patent Application 125,023; Better et al. (1988) Science 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Cancer Res.* 47:999-1005; Wood et al. (1985) *Nature* 314:446-449; and Shaw et al. (1988) *J. Natl. Cancer Inst.* 80:1553-1559; Morrison (1985) *Science* 229:1202-1207; Oi et al. (1986) *Bio/Techniques* 4:214; U.S. Pat. No. 5,225,539; Jones et al. (1986) *Nature* 321:552-525; Verhoeyan et al. (1988) *Science* 239:1534; and Beidler et al. (1988) *J. Immunol.* 141:4053-4060.

Completely human antibodies can be produced using transgenic mice which are incapable of expressing endogenous immunoglobulin heavy and light chains genes, but which can express human heavy and light chain genes. For an overview of this technology for producing human antibodies, see Lonberg and Huszar (1995) *Int. Rev. Immunol.* 13:65-93. For a detailed discussion of this technology for producing human antibodies and human monoclonal antibodies and protocols for producing such antibodies, see, e.g., U.S. Pat. Nos. 5,625,126; 5,633,425; 5,569,825; 5,661,016; and 5,545,806. In addition, companies such as Abgenix, Inc. (Freemont, CA) can be engaged to provide human antibodies directed against a selected antigen using technology similar to that described above.

An antibody directed against a fusion polypeptide described herein (e.g., a monoclonal antibody) can be used to isolate the polypeptide by standard techniques, such as affinity chromatography or immunoprecipitation. Moreover, such an antibody can be used to detect a fusion polypeptide described herein (e.g., in a cellular lysate or cell supernatant) in order to evaluate the level and pattern of expression of the fusion polypeptide. Detection can be facilitated by coupling the antibody to a detectable substance. Examples of detectable substances include, e.g., various enzymes, prosthetic groups, fluorescent materials, luminescent materials, bioluminescent materials, and radioactive materials. Examples of suitable enzymes include, e.g., horseradish peroxidase, alkaline phosphatase, β-galactosidase, or acetylcholinesterase; examples of suitable prosthetic group complexes include, e.g., streptavidin/biotin and avidin/biotin; examples of suitable fluorescent materials include, e.g., umbelliferone, fluorescein, fluorescein isothiocyanate, rhodamine, dichlorotriazinylamine fluorescein, dansyl chloride or phycoerythrin; an example of a luminescent material includes, but is not limited to, luminol; examples of bioluminescent materials include, e.g., luciferase, luciferin, and aequorin, and examples of suitable radioactive materials include, e.g., $^{125}I$, $^{131}I$, $^{35}S$ or $^{3}H$.

An antibody directed against a fusion polypeptide described herein, can also be used diagnostically to monitor protein levels in tissues or body fluids (e.g., in a tumor cell-containing body fluid) as part of a clinical testing procedure, e.g., to, for example, determine the efficacy of a given treatment regimen.

Antigens and Vaccines

Embodiments featured in the disclosure include preparations, e.g., antigenic preparations, of the entire fusion polypeptide or a fragment thereof, e.g., a fragment capable of raising antibodies specific to the fusion polypeptide, e.g., a fusion junction containing fragment (collectively referred to herein as a "fusion-specific polypeptides" or FSP). The preparation can include an adjuvant or other component.

An FSP can be used as an antigen or vaccine. For example, an FSP can be used as an antigen to immunize an animal, e.g., a rodent, e.g., a mouse or rat, rabbit, horse, goat, dog, or non-human primate, to obtain antibodies, e.g., fusion-specific antibody molecules. In an embodiment, the fusion-specific antibody molecule is a polyclonal antibody. In other embodiments, the fusion-specific antibody molecule is a monospecific antibody. In an embodiment, the fusion-specific antibody molecule is a monoclonal antibody. In an embodiment, the fusion-specific antibody molecule is a human, humanized, or chimeric antibody. A fusion-specific antibody molecule described herein can be used to treat a subject having a cancer, e.g., a cancer described herein.

Embodiments featured include vaccine preparations that comprise an FSP capable of stimulating an immune response in a subject, e.g., by raising, in the subject, antibodies specific to the fusion protein. The vaccine preparation can include other components, e.g., an adjuvant.

The antigens or vaccines described herein can be used for the treatment of a disease, e.g., a cancer, e.g., a cancer described herein. For example, antigen presenting cells (APCs) derived from a patient with a disease, e.g., cancer, e.g., a cancer described herein; can be incubated with a fusion polypeptide described herein, wherein the disease from which the patient's APCs are derived is known to express the fusion polypeptide, has been determined to express the fusion polypeptide, or is suspected of expressing the fusion polypeptide. In some embodiments, the APCs are also incubated with one or more cytokines. In some embodiments, the cytokine induces maturation of the APCs. In some embodiments, the cytokine is one or more of granulocyte-macrophage colony-stimulating factor (GMCSF), TNF-alpha, IL-4, IL-2, IL-6, IL-7, IL-13, IL-15, HGF. In some embodiments, the cytokine is GMCSF. The APCs can be incubated with the fusion polypeptide under conditions which allow the APCs to uptake or endocytose the fusion polypeptide and process the polypeptide for presentation on a cell surface molecule, e.g., major histocompatibility class MHC class I molecules. The cell culture conditions are known to one of skill in the art. The APCs can then be infused back into the same patient from whom the cells were derived.

In some embodiments, the APCs are purified prior to incubation with a fusion polypeptide. In some embodiments, the APCs are dendritic cells. In some embodiments, the APCs include one or more of dendritic cells, macrophages, and B cells. In some embodiments, the APCs are incubated with one, two, three, four, or more fusion polypeptides.

In some embodiments, the disclosure includes a preparation of mature APCs which have been incubated with a fusion polypeptide described herein.

In some embodiments, the method includes determining or acquiring a determination of whether a patient expresses a fusion polypeptide described herein. In some embodiments, the method includes selecting a fusion polypeptide based on the determination of whether a patient expresses a fusion polypeptide described herein. In some embodiments, the method further comprises incubation of APCs derived from the patient with the selected fusion polypeptide. In some embodiments, the method further comprises infusion of the APCs back into the patient from which they were derived.

Protein-Based Detection Reagents, Reaction Mixtures, and Devices

A fusion polypeptide described herein can be distinguished from a reference polypeptide, e.g., a non-mutant or wildtype protein, by reaction with a detection reagent, e.g., a substrate, e.g., a substrate for catalytic activity, e.g., phosphorylation, or an antibody that reacts differentially with a mutant protein as compared to a reference protein.

In one aspect, the disclosure includes a method of detecting a fusion polypeptide, comprising contacting a sample, e.g., a sample described herein, comprising a fusion polypeptide described herein, with such a detection reagent and determining if the fusion polypeptide is present in the sample.

Accordingly, in another aspect, the disclosure features a reaction mixture comprising: a) a polypeptide from a cancer, or a sample comprising the polypeptide, wherein the polypeptide comprises a mutation or an interrogation position for the mutation, e.g., a rearrangement or fusion junction described in FIG. 1A, 1B or 1C, or in Tables C, D, E, H, I, J, M, N, or O; and b) a detection reagent, e.g., a substrate, e.g., a substrate for catalytic activity, e.g., phosphorylation, or an antibody, that reacts differentially with a fusion polypeptide (e.g., a fusion polypeptide described herein) and a reference protein.

In another aspect, the disclosure features a method of making a reaction mixture comprising combining: a) a polypeptide from a cancer, or a sample comprising the polypeptide, wherein the polypeptide comprises a mutation or an interrogation position for the mutation, e.g., a rearrangement or fusion junction described in FIG. 1A, 1B or 1C, or in Tables C, D, E, H, I, J, M, N, or O; with b) a detection reagent, e.g., a substrate, e.g., a substrate for catalytic activity, e.g., phosphorylation, or an antibody, that reacts differentially with a fusion polypeptide (e.g., a fusion polypeptide described herein) and a reference protein.

In an embodiment, the cancer is an ovarian cancer (e.g., ovarian carcinosarcoma) or a melanoma (e.g., a vaginal melanoma). In some embodiments, the cancer is a cancer provided in Tables E, J, or O.

In an embodiment, the polypeptide or sample is from a cancer listed in FIG. 1A, and the detection reagent detects a rearrangement or fusion junction disclosed in FIG. 1A or 1B. In an embodiment, the polypeptide or sample is from a cancer listed in Table E, and the detection reagent detects a rearrangement or fusion junction provided in Tables C, D, or E. In an embodiment, the polypeptide or sample is from a cancer listed in Table J, and the detection reagent detects a rearrangement or fusion junction provided in Tables H, I, or J. In an embodiment, the polypeptide or sample is from a cancer listed in Table O, and the detection reagent detects a rearrangement or fusion junction provided in Tables M, N, or O.

In an embodiment, the polypeptide or sample is from an ovarian cancer (e.g., ovarian carcinosarcoma), and the detection reagent is one that detects a fusion of the MEX3A and NTRK1 genes, e.g., a detection reagent that detects a rearrangement or fusion junction described in FIG. 1A, 1B or 1C for a fusion of the MEX3A and NTRK1 genes.

In an embodiment, the polypeptide or sample is from a melanoma (e.g., a vaginal melanoma), and the detection reagent is one that detects a fusion of the CARM1 and NTRK3 genes, e.g., a detection reagent that detects a rearrangement or fusion junction described in FIG. 1A, 1B or 1C for a fusion of CARM1 and NTRK3.

In some embodiments, the polypeptide or sample is from a cancer provided in Table E, and the detection reagent is one that detects a fusion of an NTRK1 gene and a gene of Table A, e.g., a detection reagent that detects a rearrangement or fusion junction described in Tables C, D, or E. In some embodiments, the polypeptide or sample is from a cancer provided in Table J, and the detection reagent is one that detects a fusion of an NTRK2 gene and a gene of Table F, e.g., a detection reagent that detects a rearrangement or fusion junction described in Tables H, I, or J. In some embodiments, the polypeptide or sample is from a cancer provided in Table O, and the detection reagent is one that detects a fusion of an NTRK3 gene and a gene of Table K, e.g., a detection reagent that detects a rearrangement or fusion junction described in Tables M, N, or O.

The activity or level of a fusion polypeptide described herein can also be detected and/or quantified by detecting or quantifying the expressed polypeptide. The fusion polypeptide can be detected and quantified by any of a number of means known to those of skill in the art. These can include analytic biochemical methods such as electrophoresis, capillary electrophoresis, high performance liquid chromatography (HPLC), thin layer chromatography (TLC), hyperdiffusion chromatography, and the like, or various immunological methods such as fluid or gel precipitin reactions, immunodiffusion (single or double), immunoelectrophoresis, radioimmunoassay (RIA), enzyme-linked immunosorbent assays (ELISAs), immunofluorescent assays, Western blotting, immunohistochemistry (IHC) and the like. A skilled artisan can adapt known protein/antibody detection methods.

Another agent for detecting a fusion polypeptide is an antibody molecule capable of binding to a fusion polypeptide described herein, e.g., an antibody with a detectable label. Techniques for generating antibodies are described herein. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

In another embodiment, the antibody is labeled, e.g., a radio-labeled, chromophore-labeled, fluorophore-labeled, or enzyme-labeled antibody. In another embodiment, an antibody derivative (e.g., an antibody conjugated with a substrate or with the protein or ligand of a protein-ligand pair, e.g., biotin-streptavidin), or an antibody fragment (e.g., a single-chain antibody, an isolated antibody hypervariable domain, etc.) which binds specifically with a fusion protein described herein, is used.

Fusion polypeptides from cells can be isolated using techniques that are known to those of skill in the art. The protein isolation methods employed can, for example, be such as those described in Harlow and Lane (Harlow and Lane, 1988, *Antibodies: A Laboratory Manual*, Cold Spring Harbor Laboratory Press, Cold Spring Harbor, New York).

Means of detecting proteins using electrophoretic techniques are well known to those of skill in the art (see generally, R. Scopes (1982) *Protein Purification*, Springer-Verlag, N.Y.; Deutscher (1990) *Methods in Enzymology* Vol. 182*: Guide to Protein Purification*, Academic Press, Inc., N.Y.).

In another embodiment, Western blot (immunoblot) analysis is used to detect and quantify the presence of a polypeptide in the sample.

In another embodiment, the polypeptide is detected using an immunoassay. As used herein, an immunoassay is an assay that utilizes an antibody to specifically bind to the analyte. The immunoassay is thus characterized by detection of specific binding of a polypeptide to an anti-antibody as opposed to the use of other physical or chemical properties to isolate, target, and quantify the analyte.

The fusion polypeptide can be detected and/or quantified using any of a number of immunological binding assays (see the assays disclosed in, e.g., U.S. Pat. Nos. 4,366,241; 4,376,110; 4,517,288; and 4,837,168). For a review of the general immunoassays, see also Asai (1993) *Methods in Cell Biology* Volume 37*: Antibodies in Cell Biology*, Academic Press, Inc. New York; Stites & Terr (1991) *Basic and Clinical Immunology* 7th Edition.

Expression Vectors, Host Cells and Recombinant Cells

In another aspect, the disclosure includes vectors (e.g., expression vectors) containing a fusion nucleic acid molecule described herein, or a nucleic acid molecule encoding a fusion polypeptide described herein. As used herein, the term "vector" refers to a nucleic acid molecule capable of transporting another nucleic acid to which it has been linked and can include a plasmid, cosmid or viral vector. The vector can be capable of autonomous replication or it can integrate into a host DNA. Viral vectors include, e.g., replication defective retroviruses, adenoviruses and adeno-associated viruses.

A vector can include a fusion nucleic acid in a form suitable for expression of the nucleic acid in a host cell. Preferably the recombinant expression vector includes one or more regulatory sequences operatively linked to the nucleotide sequence to be expressed. The term "regulatory sequence" includes promoters, enhancers and other expression control elements (e.g., polyadenylation signals). Regulatory sequences include those which direct constitutive expression of a nucleotide sequence, as well as tissue-specific regulatory and/or inducible sequences. The design of the expression vector can depend on such factors as the choice of the host cell to be transformed, the level of expression of protein desired, and the like. The expression vectors can be introduced into host cells to thereby produce a fusion polypeptide, including fusion proteins or polypeptides encoded by nucleic acids as described herein, mutant forms thereof, and the like.

The term "recombinant host cell" (or simply "host cell" or "recombinant cell"), as used herein, is intended to refer to a cell into which a recombinant expression vector has been introduced. It should be understood that such terms are intended to refer not only to the particular subject cell, but to the progeny of such a cell. Because certain modifications may occur in succeeding generations due to either mutation or environmental influences, such progeny may not, in fact, be identical to the parent cell, but are still included within the scope of the term "host cell" as used herein.

The recombinant expression vectors can be designed for expression of a fusion polypeptide (e.g., a fusion molecule described herein) in prokaryotic or eukaryotic cells. For example, polypeptides featured in the disclosure can be expressed in *E. coli*, insect cells (e.g., using baculovirus expression vectors), yeast cells or mammalian cells. Suitable host cells are discussed further in Goeddel (1990) *Gene Expression Technology: Methods in Enzymology* 185, Academic Press, San Diego, CA Alternatively, the recombinant expression vector can be transcribed and translated in vitro, for example using T7 promoter regulatory sequences and T7 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith, D. B. and Johnson, K. S. (1988) *Gene* 67:31-40), pMAL (New England Biolabs, Beverly, MA) and pRIT5 (Pharmacia, Piscataway, NJ) which fuse glutathione S-transferase (GST), maltose E binding protein, or protein A, respectively, to the target recombinant protein.

Purified fusion polypeptides described herein can be used in activity assays (e.g., direct assays or competitive assays described in detail below), or to generate antibodies specific for fusion polypeptides described herein.

To maximize recombinant protein expression in *E. coli*, the protein can be expressed in host bacteria with an impaired capacity to proteolytically cleave the recombinant protein (Gottesman, S. (1990) *Gene Expression Technology: Methods in Enzymology* 185, Academic Press, San Diego, California 119-128). Another strategy is to alter the nucleotide sequence of the nucleic acid to be inserted into an expression vector so that the individual codons for each amino acid are those preferentially utilized in *E. coli* (Wada et al. (1992) *Nucleic Acids Res.* 20:2111-2118) or the desired host cell. Such alteration of nucleotide sequences can be carried out by standard DNA synthesis techniques.

The fusion polypeptide expression vector can be a yeast expression vector, a vector for expression in insect cells, e.g., a baculovirus expression vector or a vector suitable for expression in mammalian cells.

When used in mammalian cells, the expression vector's control functions can be provided by viral regulatory elements. For example, commonly used promoters are derived from polyoma, Adenovirus 2, cytomegalovirus and Simian Virus 40.

In another embodiment, the promoter is an inducible promoter, e.g., a promoter regulated by a steroid hormone, by a polypeptide hormone (e.g., by means of a signal transduction pathway), or by a heterologous polypeptide (e.g., the tetracycline-inducible systems, "Tet-On" and "Tet-Off"; see, e.g., Clontech Inc., CA, Gossen and Bujard (1992) *Proc. Natl. Acad. Sci. USA* 89:5547, and Paillard (1989) *Human Gene Therapy* 9:983).

In another embodiment, the recombinant mammalian expression vector is capable of directing expression of the nucleic acid preferentially in a particular cell type (e.g., tissue-specific regulatory elements are used to express the nucleic acid). Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *Proc. Natl. Acad. Sci. USA* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example, the murine hox promoters (Kessel and Gruss (1990) *Science* 249:374-379) and the fetoprotein promoter (Campes and Tilghman (1989) *Genes Dev.* 3:537-546).

The disclosure further provides a recombinant expression vector comprising a DNA molecule featured in the disclosure cloned into the expression vector in an antisense orientation. Regulatory sequences (e.g., viral promoters and/or enhancers) operatively linked to a nucleic acid cloned in the antisense orientation can be chosen which direct the constitutive, tissue specific or cell type specific expression of antisense RNA in a variety of cell types. The antisense expression vector can be in the form of a recombinant plasmid, phagemid or attenuated virus.

Another aspect the disclosure provides a host cell which includes a fusion nucleic acid molecule described herein, e.g., a fusion nucleic acid molecule described herein within a recombinant expression vector or a fusion nucleic acid molecule described herein containing sequences which allow it to homologously recombine into a specific site of the host cell's genome.

A host cell can be any prokaryotic or eukaryotic cell. For example, a fusion polypeptide can be expressed in bacterial cells (such as *E. coli*), insect cells, yeast or mammalian cells (such as Chinese hamster ovary cells (CHO) or COS cells, e.g., COS-7 cells, CV-1 origin SV40 cells; Gluzman (1981) *Cell* 23:175-182). Other suitable host cells are known to those skilled in the art.

Vector DNA can be introduced into host cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation.

A host cell can be used to produce (e.g., express) a fusion polypeptide described herein. Accordingly, the disclosure further provides methods for producing a fusion polypeptide using host cells. In one embodiment, the method includes culturing the host cell (into which a recombinant expression vector encoding a polypeptide has been introduced) in a suitable medium such that the fusion polypeptide is produced. In another embodiment, the method further includes isolating a fusion polypeptide from the medium or the host cell.

The cell preparation can consist of human or non-human cells, e.g., rodent cells, e.g., mouse or rat cells, rabbit cells, or pig cells. In some embodiments, the cell or cells include a fusion transgene, e.g., a heterologous form of a fusion molecule described herein, e.g., a gene derived from humans (in the case of a non-human cell) or a fusion transgene, e.g., a heterologous form of a fusion molecule described herein. The fusion transgene can be misexpressed, e.g., overexpressed or underexpressed. In other embodiments, the cell or cells include a gene that mis-expresses an endogenous fusion, e.g., a gene the expression of which is disrupted, e.g., a knockout. Such cells can serve as a model for studying disorders that are related to mutated or mis-expressed fusion alleles (e.g., cancers) or for use in drug screening, as described herein.

In another aspect, the disclosure features a cell or a preparation of cells which include a fusion transgene, or which otherwise misexpress the fusion. For example, a cell or a preparation of cells which include a MEX3A-NTRK1 fusion transgene, or which otherwise misexpress a MEX3A-NTRK1 fusion. For another example, a cell or a preparation of cells which include a CARM1-NTRK3 fusion transgene, or which otherwise misexpress a CARM1-NTRK3 fusion.

In another aspect, provided herein are cells or a preparations of cells which include a fusion transgene, or which otherwise misexpress the fusion. For example, a cell or a preparation of cells which include a fusion transgene of an NTRK1 fusion of Tables C, D, or E, or which otherwise misexpress a fusion transgene of an NTRK1 fusion of Tables C, D, or E. For example, a cell or a preparation of cells which include a fusion transgene of an NTRK2 fusion of Tables H, I, or J, or which otherwise misexpress a fusion transgene of an NTRK2 fusion of Tables H, I, or J. For example, a cell or a preparation of cells which include a fusion transgene of an NTRK3 fusion of Tables M, N, or O, or which otherwise misexpress a fusion transgene of an NTRK2 fusion of Tables M, N, or O.

In another aspect, the disclosure features a cell or a preparation of cells which include a fusion transgene, or which otherwise express the fusion. For example, a cell or a preparation of cells which include a MEX3A-NTRK1 fusion transgene, or which otherwise express a MEX3A-NTRK1 fusion. For another example, a cell or a preparation of cells which include a CARM1-NTRK3 fusion transgene, or which otherwise express a CARM1-NTRK3 fusion.

In another aspect, provided herein are cells or a preparations of cells which include a fusion transgene, or which otherwise express the fusion. For example, a cell or a preparation of cells which include a fusion transgene of an NTRK1 fusion of Tables C, D, or E, or which otherwise express a fusion transgene of an NTRK1 fusion of Tables C, D, or E. For example, a cell or a preparation of cells which include a fusion transgene of an NTRK2 fusion of Tables H, I, or J, or which otherwise express a fusion transgene of an NTRK2 fusion of Tables H, I, or J. For example, a cell or a preparation of cells which include a fusion transgene of an NTRK3 fusion of Tables M, N, or O, or which otherwise express a fusion transgene of an NTRK2 fusion of Tables M, N, or O.

Methods

The method steps of the invention(s) described herein are intended to include any suitable method of causing one or more other parties or entities to perform the steps, unless a different meaning is expressly provided or otherwise clear from the context. Such parties or entities need not be under the direction or control of any other party or entity, and need not be located within a particular jurisdiction. Thus for example, a description or recitation of "adding a first number to a second number" includes causing one or more parties or entities to add the two numbers together. For example, if person X engages in an arm's length transaction with person Y to add the two numbers, and person Y indeed adds the two numbers, then both persons X and Y perform the step as recited: person Y by virtue of the fact that he actually added the numbers, and person X by virtue of the fact that he caused person Y to add the numbers. Furthermore, if person X is located within the United States and person Y is located outside the United States, then the method is performed in the United States by virtue of person X's participation in causing the step to be performed.

Methods of Detection

In one aspect, provided herein are methods of detecting a gene fusion provided herein, e.g., an NTRK1, NTRK2, or NTRK3 fusion.

In another aspect, provided herein are methods of assessing or diagnosing a fusion provided herein, e.g., an NTRK1, NTRK2, or NTRK3 fusion, e.g., in an individual, or in a cancer or tumor. In some embodiments, the methods comprise detecting a fusion provided herein, e.g., an NTRK1, NTRK2, or NTRK3 fusion (e.g., in a sample); and providing an assessment or diagnosis of the gene fusion when the fusion, e.g., an NTRK1, NTRK2, or NTRK3 fusion is detected.

In another aspect, provided herein are methods of identifying an individual having cancer who may benefit from a treatment comprising a targeted therapy. In some embodiments, the methods comprise detecting a fusion provided herein, e.g., an NTRK1, NTRK2, or NTRK3 fusion (e.g., in a sample), wherein detection of the gene fusion identifies the individual as one who may benefit from a targeted therapy of the present disclosure, e.g., a kinase inhibitor. In some embodiments, the methods further comprise, after detection of the fusion, providing the individual with a recommendation of a treatment comprising the targeted therapy (e.g., responsive at least in part to detection of the fusion).

In another aspect, provided herein are methods of selecting a therapy for an individual having cancer. In some embodiments, the methods comprise detecting a fusion provided herein, e.g., an NTRK1, NTRK2, or NTRK3 fusion (e.g., in a sample), wherein detection of the fusion identifies the individual as one who may benefit from a targeted therapy of the present disclosure, e.g., a kinase inhibitor. In some embodiments, the methods further comprise, after detection of the fusion, selecting a therapy for the individual that targets the fusion detected (e.g., responsive at least in part to the detection of the NTRK1, NTRK2, or NTRK3 fusion).

In another aspect, provided herein are methods of selecting a therapy or treatment for an individual having cancer. In some embodiments, the methods comprise acquiring knowledge of a translocation comprising one or more breakpoints described herein, e.g., Breakpoint 1 and/or Breakpoint 2 provided in Tables E, J, or O. In some embodiments, the methods further comprise, after detection of the fusion, selecting a therapy or treatment for the individual that targets the fusion (e.g., responsive at least in part to the detection of the NTRK1, NTRK2, or NTRK3 fusion). In some embodiments, the subject is classified as a candidate to receive treatment with a targeted therapy, e.g., a kinase inhibitor, of the present disclosure (e.g., responsive at least in part to the acquisition of the knowledge) and/or the subject is identified as likely to respond to a treatment that comprises a targeted therapy of the present disclosure (e.g., responsive at least in part to the acquisition of the knowledge).

In another aspect, provided herein are methods of identifying one or more treatment options for an individual having cancer. In some embodiments, the methods comprise detecting a fusion provided herein, e.g., an NTRK1, NTRK2, or NTRK3 fusion (e.g., in a sample); and generating a report comprising one or more treatment options identified for the individual, e.g., based at least in part on detection of the fusion. In some embodiments, the one or more treatment options comprise a targeted therapy of the present disclosure, e.g., a kinase inhibitor.

In another aspect, provided herein are methods of identifying one or more treatment options for an individual having cancer. In some embodiments, the methods comprise acquiring knowledge of a gene fusion provided herein, e.g., an NTRK1, NTRK2, or NTRK3 fusion (e.g., in a sample); and generating a report comprising one or more treatment options identified for the individual, e.g., based at least in part on knowledge of the fusion. In some embodiments, the one or more treatment options comprise a targeted therapy of the present disclosure, e.g., a kinase inhibitor.

In some embodiments, the methods of the present disclosure further comprise providing a report (e.g., to another party). In some embodiments, the report comprises: information on the role of the fusion, e.g., the NTRK1, NTRK2, or NTRK3 fusion, or wild-type sequence, in disease; information on prognosis, resistance, or potential or suggested therapeutic options for the subject; information on the likely effectiveness of a therapeutic option, the acceptability of a therapeutic option, or the advisability of applying a therapeutic option to the subject; or information, or a recommendation on, the administration of a drug (e.g., a targeted therapy of the present disclosure, e.g., a kinase inhibitor) to the subject.

Methods described herein can include providing a report, such as, in electronic, web-based, or paper form, to the patient or to another person or entity, e.g., a caregiver, e.g., a physician, e.g., an oncologist, a hospital, clinic, third-party payor, insurance company or government entity. The report can include output from the method, e.g., the indication of the presence or absence of a fusion provided herein, e.g., an NTRK1, NTRK2, or NTRK3 fusion. In one embodiment, a report is generated, such as in paper or electronic form, which identifies the presence or absence of a fusion provided herein, e.g., an NTRK1, NTRK2, or NTRK3 fusion, and optionally includes an identifier for the patient from which the sequence was obtained. The report can also include information on the role of a fusion provided herein, e.g., an NTRK1, NTRK2, or NTRK3 fusion, or wild-type sequence, in disease. Such information can include information on prognosis, resistance, or potential or suggested therapeutic options. The report can include information on the likely effectiveness of a therapeutic option, the acceptability of a therapeutic option, or the advisability of applying the therapeutic option to a patient, e.g., a patient having a sequence, alteration or mutation identified in the test, and in some embodiments, identified in the report. For example, the report can include information, or a recommendation on, the administration of a drug, e.g., the administration at a dosage or in a treatment regimen, e.g., in combination with other drugs, to the patient. In an embodiment, not all mutations identified in the method are identified in the report. For example, the report can be limited to disclosing mutations in genes having a level of correlation with the occurrence, prognosis, stage, or susceptibility of a cancer to a treatment, e.g., with a therapeutic option. The report can be delivered, e.g., to an entity described herein, within about or approximately 7, 14, or 21 days from receipt of the sample by an entity practicing the method of providing a report.

In some embodiments, the methods of the present disclosure further comprise generating a report, e.g., a personalized cancer treatment report, by obtaining a sample, e.g., a tumor sample, from a subject, and detecting a fusion provided herein, e.g., an NTRK1, NTRK2, or NTRK3 fusion, in the sample. In one embodiment, a report is generated that annotates a selected treatment, or that lists, e.g., in order of preference, two or more treatment options based on the mutation identified. In another embodiment, the subject, e.g., a patient, is further administered one or both of the treatment options.

In some embodiments, the methods of the present disclosure further comprise one or more of (e.g., responsive at least in part to the detection of a fusion provided herein, e.g., an NTRK1, NTRK2, or NTRK3 fusion, or responsive at least in part to acquisition of knowledge thereof):

(1) stratifying a patient population (e.g., assigning a subject, e.g., a patient, to a group or class);

(2) identifying or selecting a subject as likely or unlikely to respond to a treatment, e.g., a targeted therapy as described herein, e.g., a kinase inhibitor;

(3) selecting a treatment option, e.g., administering or not administering a targeted therapy as described herein, e.g., a kinase inhibitor; or 4) prognosticating the time course of a disease in the subject (e.g., evaluating the likelihood of increased or decreased patient survival).

In certain embodiments, responsive to the determination of the presence a fusion provided herein, e.g., an NTRK1, NTRK2, or NTRK3 fusion, the patient is classified as a candidate to receive treatment with a targeted therapy as described herein, e.g., a kinase inhibitor In one embodiment, responsive to the determination of the presence of a fusion provided herein, e.g., an NTRK1, NTRK2, or NTRK3 fusion, the patient can further be assigned to a particular class if a fusion provided herein, e.g., an NTRK1, NTRK2, or NTRK3 fusion, is identified in a sample of the patient. For example, a patient identified as having a fusion provided herein, e.g., an NTRK1, NTRK2, or NTRK3 fusion, can be classified as a candidate to receive treatment with a therapy targeting a fusion or its gene product. In one embodiment, the patient is assigned to a second class if the fusion is not present. For example, the patient who has a cancer that does not contain a fusion provided herein, e.g., an NTRK1, NTRK2, or NTRK3 fusion may be determined as not being a candidate to receive a targeted therapy described herein.

In another aspect, provided herein are methods of treating or delaying progression of cancer. In some embodiments, the methods comprise administering to an individual an effective amount of a targeted therapy of the present disclosure, e.g., a kinase inhibitor. In some embodiments, the cancer comprises a fusion provided herein, e.g., an NTRK1, NTRK2, or NTRK3 fusion. In some embodiments, the targeted therapy is administered responsive at least in part to knowledge and/or detection of a fusion provided herein, e.g., an NTRK1, NTRK2, or NTRK3 fusion, e.g., in a sample from the individual. In some embodiments, the methods further comprise detecting a fusion provided herein, e.g., an NTRK1, NTRK2, or NTRK3 fusion, e.g., in a sample from an individual. In some embodiments, the fusion is detected in vitro, e.g., as described herein. In some embodiments, the methods further comprise acquiring knowledge of a fusion provided herein, e.g., an NTRK1, NTRK2, or NTRK3 fusion, e.g., in a sample from an individual. In some embodiments, the methods further comprise obtaining a sample from the individual.

The methods of the present disclosure are contemplated for use with a variety of cancers. In some embodiments, a cancer of the present disclosure is a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, or a salivary gland carcinoma. In some embodiments, a cancer of the present disclosure is an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, or a brain medulloblastoma. In some embodiments, a cancer of the present disclosure is a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, or a colon adenocarcinoma.

Exemplary formulations for targeted therapies and methods of administration thereof are provided infra.

In another aspect, the disclosure features a method of determining the presence of a fusion nucleic acid molecule or polypeptide as described herein. In one embodiment, the fusion nucleic acid molecule is detected. In another embodiment, the fusion polypeptide is detected. The method includes detecting whether a fusion nucleic acid molecule or polypeptide is present in a cell (e.g., a circulating cell), a tissue (e.g., a tumor), or a sample, e.g., a sample described herein, from a subject. In one embodiment, the sample is a nucleic acid sample. In one embodiment, the nucleic acid sample comprises DNA (e.g., cfDNA or ctDNA), e.g., genomic DNA or cDNA, or RNA, e.g., mRNA. In other embodiments, the sample is a protein sample.

In one embodiment, the sample is, or has been, classified as non-malignant using other diagnostic techniques, e.g., immunohistochemistry.

In one embodiment, the sample is acquired from a subject (e.g., a subject having or at risk of having a cancer, e.g., a patient), or alternatively, the method further includes acquiring a sample from the subject. The sample can be chosen from one or more of: tissue, e.g., cancerous tissue (e.g., a tissue biopsy), whole blood, serum, plasma, buccal scrape, sputum, saliva, cerebrospinal fluid, urine, stool, circulating tumor cells, circulating nucleic acids, or bone marrow. In certain some embodiments, the sample comprises a tissue (e.g., a tumor biopsy), a circulating tumor cell (CTC), or a nucleic acid. In some embodiments, a sample is a tumor sample or otherwise comprises tumor DNA from a cancer of the present disclosure, e.g., a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, or a salivary gland carcinoma. In some embodiments, a sample is a tumor sample or otherwise comprises tumor DNA from a cancer of the present disclosure, e.g., an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, or a brain medulloblastoma. In some embodiments, a cancer of the present disclosure is a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, or a colon adenocarcinoma. In some embodiments, a sample is a tumor sample or otherwise comprises tumor DNA from a cancer of the present disclosure, e.g., an ovarian carcinosarcoma, vaginal melanoma, salivary gland mammary analogue secretory carcinoma, soft tissue fibrosarcoma, a salivary gland tumor, histiocytosis, a thyroid tumor, a soft tissue sarcoma, or chondrosarcoma.

In some embodiments, the tumor is from a cancer described herein, e.g., is chosen from a carcinosarcoma, melanoma, carcinoma, fibrosarcoma, a salivary gland tumor, histiocytosis, a thyroid tumor, a soft tissue sarcoma, or chondrosarcoma. In one embodiment, the cancer is chosen from ovarian carcinosarcoma or vaginal melanoma. In one embodiment, the cancer is ovarian carcinosarcoma. In another embodiment, the cancer is an ovarian cancer (e.g., an ovarian carcinosarcoma) that has an alteration in the NTRK1 gene or the MEX3A gene, e.g., has a MEX3A-NTRK1 fusion nucleic acid molecule or polypeptide described herein. In one embodiment, the cancer is vaginal melanoma. In another embodiment, the cancer is a melanoma (e.g., a vaginal melanoma) that has an alteration in the NTRK3 gene or the CARM1 gene, e.g., has a CARM1-NTRK3 fusion nucleic acid molecule or polypeptide described herein.

In some embodiments, the tumor is from a cancer described herein, e.g., a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, or a salivary gland carcinoma.

In some embodiments, the tumor is from a cancer described herein, e.g., an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, or a brain medulloblastoma.

In some embodiments, the tumor is from a cancer described herein, e.g., a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, or a colon adenocarcinoma.

In some embodiments, the cancer is an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, or a brain medulloblastoma. In some embodiments, the cancer is an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, or a brain medulloblastoma that has an alteration in the NTRK1 gene or in a gene of Table A, e.g., has an NTRK1 fusion nucleic acid molecule or polypeptide described herein (e.g., in Tables C, D, or E). In some embodiments, the colorectal cancer comprises high microsatellite instability.

In some embodiments, the cancer is a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, or a colon adenocarcinoma. In some embodiments, the cancer is a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, or a colon adenocarcinoma that has an alteration in the NTRK2 gene or in a gene of Table F, e.g., has an NTRK2 fusion nucleic acid molecule or polypeptide described herein (e.g., in Tables H, I, or J). In some embodiments, the colorectal cancer comprises high microsatellite instability.

In some embodiments, the cancer is a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma. In some embodiments, the cancer is a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma that has an alteration in the NTRK3 gene or in a gene of Table K, e.g., has an NTRK3 fusion nucleic acid molecule or polypeptide described herein (e.g., in Tables M, N, or O).

In some embodiments, the cancer does not have an alteration in one or more of ALK, BRAF, ERBB2, EGFR, ROS1, or KRAS. In some embodiments, the cancer has no detectable altered level or activity in one or more of EGFR, KRAS, ALK, ROS1 or RET. In some embodiments, the cancer comprises a tumor mutation burden of 20 mut/mB or more.

In one embodiment, the subject is at risk of having, or has a cancer (e.g., a patient with a cancer described herein).

In other embodiments, the fusion nucleic acid molecule is detected by a method chosen from one or more of: nucleic acid hybridization assay, an amplification-based assay (e.g., polymerase chain reaction (PCR)), a PCR-RFLP assay, real-time PCR, sequencing, a screening analysis (including metaphase cytogenetic analysis by standard karyotype methods, FISH (e.g., break away FISH), spectral karyotyping or MFISH, comparative genomic hybridization), in situ hybridization, single specific primer-polymerase chain reaction (SSP-PCR), HPLC or mass-spectrometric genotyping.

In one embodiment, the method includes: contacting a nucleic acid sample, e.g., a genomic DNA sample (e.g., a chromosomal sample or a fractionated, enriched or otherwise pre-treated sample) or a gene product (mRNA, cDNA), obtained from the subject, with a nucleic acid fragment (e.g., a probe or primer as described herein (e.g., an exon-specific probe or primer) under conditions suitable for hybridization, and determining the presence or absence of the fusion nucleic acid molecule. The method can, optionally, include enriching a sample for the gene or gene product.

In a related aspect, a method for determining the presence of a fusion nucleic acid molecule described herein is provided. The method includes: acquiring a read for a position in a nucleic acid from a sample, e.g., by sequencing at least one nucleotide of the nucleic acid, thereby determining that the fusion nucleic acid molecule is present. Optionally, the read acquired is compared to a reference sequence, or a wildtype reference sequence. In one embodiment, the nucleic acid is from a cell (e.g., a circulating cell), a tissue (e.g., a tumor), or any sample from a subject (e.g., blood or plasma sample). In other embodiments, the nucleic acid is sequenced. In one embodiment, the sequence is determined by a next generation sequencing method. The method further can further include acquiring, e.g., directly or indirectly acquiring, a sample, e.g., a sample described herein, from a subject (e.g., a patient). In some embodiments, the cancer is chosen from e.g., carcinosarcoma (e.g., ovarian carcinosarcoma), melanoma (e.g., vaginal melanoma), carcinoma, fibrosarcoma, a salivary gland tumor, histiocytosis, a thyroid tumor, a soft tissue sarcoma, or chondrosarcoma. In some embodiments, the cancer is chosen from a cancer provided in Tables E, J, or O.

In another aspect, the disclosure features a method of analyzing a sample. The method includes acquiring a nucleic acid sample; and sequencing, e.g., by a next generation sequencing method, a nucleic acid, e.g., a nucleic acid that includes a fusion nucleic acid molecule as described herein.

In yet other embodiments, a fusion polypeptide is detected. The method includes: contacting a protein sample with a reagent which specifically binds to a fusion polypeptide described herein; and detecting the formation of a complex of the fusion polypeptide and the reagent. In one embodiment, the reagent is labeled with a detectable group to facilitate detection of the bound and unbound reagent. In one embodiment, the reagent is an antibody molecule, e.g., is selected from the group consisting of an antibody, and antibody derivative, and an antibody fragment.

In yet another embodiment, the level (e.g., expression level) or activity the fusion nucleic acid molecule or polypeptide is evaluated. For example, the level (e.g., expression level) or activity of the fusion nucleic acid molecule (e.g., mRNA) or polypeptide is detected and (optionally) compared to a pre-determined value, e.g., a reference value (e.g., a control sample).

In yet another embodiment, the fusion nucleic acid molecule or polypeptide is detected prior to initiating, during, or after, a treatment, e.g., treatment with a kinase inhibitor, of a subject having a fusion nucleic acid molecule or polypeptide described herein.

In one embodiment, the fusion nucleic acid molecule or polypeptide is detected at the time of diagnosis with a cancer. In other embodiment, the fusion nucleic acid molecule or polypeptide is detected at a pre-determined interval, e.g., a first point in time and at least at a subsequent point in time.

In certain embodiments, responsive to a determination of the presence of the fusion nucleic acid molecule or polypeptide, the method further includes one or more of:

(1) stratifying a patient population (e.g., assigning a subject, e.g., a patient, to a group or class); (2) identifying or selecting a subject as likely or unlikely to respond to a treatment, e.g., a kinase inhibitor treatment as described herein; (3) selecting a treatment option, e.g., administering or not administering a therapeutic agent, e.g., a kinase inhibitor as described herein; or (4) prognosticating the time course of a disease in the subject (e.g., evaluating the likelihood of increased or decreased patient survival).

In certain embodiments, the kinase inhibitor is a multi-kinase inhibitor or a specific inhibitor.

In certain embodiments, responsive to the determination of the presence of a fusion nucleic acid molecule or polypeptide described herein, the subject is classified as a candidate to receive treatment with a kinase inhibitor, e.g., a kinase inhibitor as described herein. In one embodiment, responsive to the determination of the presence of a fusion nucleic acid molecule or polypeptide described herein, the subject, e.g., a patient, can further be assigned to a particular class if a fusion nucleic acid molecule or polypeptide is identified in a sample of the patient. For example, a patient identified as having a fusion nucleic acid molecule or polypeptide described herein can be classified as a candidate to receive treatment with a kinase inhibitor, e.g., a specific kinase inhibitor as described herein. In one embodiment, the subject, e.g., a patient, is assigned to a second class if the mutation is not present. For example, a patient who has ovarian cancer (e.g., ovarian carcinosarcoma) that does not contain a fusion nucleic acid molecule or polypeptide described herein (e.g., a MEX3A-NTRK1 fusion nucleic acid molecule polypeptide described herein) may be determined as not being a candidate to receive a kinase inhibitor, e.g., a specific kinase inhibitor described herein. For example, a patient who has a melanoma (e.g., a vaginal melanoma) that does not contain a fusion nucleic acid molecule or polypeptide described herein (e.g., a CARM1-NTRK3 fusion nucleic acid molecule or polypeptide described herein) may be determined as not being a candidate to receive a kinase inhibitor, e.g., a specific kinase inhibitor as described herein. For example, a patient who has a cancer provided in Tables E, J, or O that does not contain a fusion nucleic acid molecule or polypeptide described herein (e.g., in Tables C, D, E, H, I, J, M, N, or O) may be determined as not being a candidate to receive a kinase inhibitor, e.g., a specific kinase inhibitor described herein. In another embodiment, responsive to the determination of the presence of the fusion nucleic acid molecule or polypeptide, the subject is identified as likely to respond to a treatment that comprises a kinase inhibitor e.g., a kinase inhibitor as described herein. In another embodiment, responsive to the determination of the presence of the fusion nucleic acid molecule or polypeptide, the subject is identified as likely to respond to a treatment that comprises a kinase inhibitor e.g., a kinase inhibitor as described herein. In yet another embodiment, responsive to the determination of the presence of the fusion nucleic acid molecule or polypeptide, the method includes administering a kinase inhibitor, e.g., a kinase inhibitor as described herein, to a subject.

Methods for evaluating a fusion gene, mutations and/or gene products are known to those of skill in the art. In one embodiment, the fusion is detected in a nucleic acid molecule by a method chosen from one or more of: a nucleic acid hybridization assay, an amplification-based assay (e.g., polymerase chain reaction (PCR)), a PCR-RFLP assay, real-time PCR, sequencing, screening analysis (including metaphase cytogenetic analysis by standard karyotype methods, FISH (e.g., break away FISH), spectral karyotyping or MFISH, comparative genomic hybridization), in situ hybridization, SSP, HPLC, or mass-spectrometric genotyping.

Additional exemplary methods include, traditional "direct probe" methods such as Southern blots or in situ hybridization (e.g., fluorescence in situ hybridization (FISH) and FISH plus SKY), and "comparative probe" methods such as comparative genomic hybridization (CGH), e.g., cDNA-based or oligonucleotide-based CGH. The methods can be used in a wide variety of formats including, but not limited to, substrate (e.g., membrane or glass) bound methods or array-based approaches.

In certain embodiments, the evaluation methods include the probes/primers described herein. In one embodiment, probes/primers can be designed to detect a fusion molecule described herein. Probes/primers are suitable, e.g., for FISH or PCR amplification. For PCR, e.g., to amplify a region including a fusion junction described herein, forward primers can be designed to hybridize to a gene sequence from nucleotides corresponding to one of the genes of a fusion molecule described herein, and reverse primers can be designed to hybridize to a sequence from nucleotides corresponding to the other gene involved in the fusion.

For example, probes/primers can be designed to detect a MEX3A-NTRK1 fusion nucleic acid molecule. The MEX3A-NTRK1 probes/primers can hybridize to the nucleotides encoding one or more exons of the MEX3A protein or to nucleotides encoding one or more exons of the NTRK1 protein. These probes/primers are suitable, e.g., for FISH or PCR amplification. The probes/primers described above use MEX3A-NTRK1 as an example, and such methods can be readily applied to any of the fusions described herein by one of skill in the art.

For example, probes/primers can be designed to detect a CARM1-NTRK3 fusion nucleic acid molecule. The CARM1-NTRK3 probes/primers can hybridize to the nucleotides encoding one or more exons of the CARM1 protein or to the nucleotides encoding one or more exons of the NTRK3 protein. These probes/primers are suitable, e.g., for FISH or PCR amplification. The probes/primers described above use CARM1-NTRK3 as an example, and such methods can be readily applied to any of the fusions described herein by one of skill in the art.

For example, probes/primers can be designed to detect an NTRK1 fusion nucleic acid molecule, e.g., an NTRK1 fusion nucleic acid molecule provided in Tables C or E. The NTRK1 fusion probes/primers can hybridize to the nucleotides encoding one or more exons of a protein provided in Table B or to nucleotides encoding one or more exons of the NTRK1 protein. These probes/primers are suitable, e.g., for FISH or PCR amplification.

For example, probes/primers can be designed to detect an NTRK2 fusion nucleic acid molecule, e.g., an NTRK2 fusion nucleic acid molecule provided in Tables H or J. The NTRK2 fusion probes/primers can hybridize to the nucleotides encoding one or more exons of a protein provided in Table G or to nucleotides encoding one or more exons of the NTRK2 protein. These probes/primers are suitable, e.g., for FISH or PCR amplification.

For example, probes/primers can be designed to detect an NTRK3 fusion nucleic acid molecule, e.g., an NTRK3 fusion nucleic acid molecule provided in Tables M or O. The NTRK3 fusion probes/primers can hybridize to the nucleotides encoding one or more exons of a protein provided in Table L or to nucleotides encoding one or more exons of the NTRK3 protein. These probes/primers are suitable, e.g., for FISH or PCR amplification.

In one embodiment, FISH analysis is used to identify the chromosomal rearrangement resulting in the fusions as described above. For example, to perform FISH, at least a first probe tagged with a first detectable label can be designed to target a first gene of a fusion molecule described herein, such as in one or more exons of the gene and at least a second probe tagged with a second detectable label can be designed to target a second gene of the fusion, such as in one or more exons of genes (e.g., the exons containing the part of the protein that includes the tyrosine kinase domain). The at least one first probe and the at least one second probe will be closer together in a subject who carries the fusion compared to a subject who does not carry the fusion.

In one approach, a variation of a FISH assay, e.g., "break-away FISH", is used to evaluate a patient. By this method, at least one probe targeting the fusion junction and at least one probe targeting an individual gene of the fusion, e.g., at one or more exons and or introns of the gene, are utilized. In normal cells, both probes will be observed (or a secondary color will be observed due to the close proximity of the two genes of the gene fusion), and only the single gene probe will be observed when the rearrangement (e.g., inversion or translocation) occurs. Other variations of the FISH method known in the art are suitable for evaluating a patient.

Probes can be used that contain DNA segments that are essentially complementary to DNA base sequences existing in different portions of chromosomes. Examples of probes useful according to the disclosure, and labeling and hybridization of probes to samples are described in two U.S. patents to Vysis, Inc., U.S. Pat. Nos. 5,491,224 and 6,277,569 to Bittner, et al.

Additional protocols for FISH detection are described below.

Chromosomal probes are typically about 50 to about 105 nucleotides. Longer probes typically comprise smaller fragments of about 100 to about 500 nucleotides. Probes that hybridize with centromeric DNA and locus-specific DNA are available commercially, for example, from Vysis, Inc. (Downers Grove, Ill.), Molecular Probes, Inc. (Eugene, Oreg.) or from Cytocell (Oxfordshire, UK). Alternatively, probes can be made non-commercially from chromosomal or genomic DNA through standard techniques. For example, sources of DNA that can be used include genomic DNA, cloned DNA sequences, somatic cell hybrids that contain one, or a part of one, chromosome (e.g., human chromosome) along with the normal chromosome complement of the host, and chromosomes purified by flow cytometry or microdissection. The region of interest can be isolated through cloning, or by site-specific amplification via the polymerase chain reaction (PCR). See, for example, Nath and Johnson, Biotechnic Histochem., 1998, 73(1):6-22, Wheeless et al., Cytometry 1994, 17:319-326, and U.S. Pat. No. 5,491,224.

The probes to be used hybridize to a specific region of a chromosome to determine whether a cytogenetic abnormality is present in this region. One type of cytogenetic abnormality is a deletion. Although deletions can be of one or more entire chromosomes, deletions normally involve loss of part of one or more chromosomes. If the entire region of a chromosome that is contained in a probe is deleted from a cell, hybridization of that probe to the DNA from the cell will normally not occur and no signal will be present on that chromosome. If the region of a chromosome that is partially contained within a probe is deleted from a cell, hybridization of that probe to the DNA from the cell can still occur, but less of a signal can be present. For example, the loss of a signal is compared to probe hybridization to DNA from control cells that do not contain the genetic abnormalities which the probes are intended to detect. In some embodiments, at least 1, 5, 10, 20, 30, 40, 50, 60, 70, 80, 90, 100, 110, 120, 130, 140, 150, 160, 170, 180, 190, 200, or more cells are enumerated for presence of the cytogenetic abnormality.

Cytogenetic abnormalities to be detected can include, e.g., non-reciprocal translocations, balanced translocations, intra-chromosomal inversions, point mutations, deletions, gene copy number changes, gene expression level changes, and germ line mutations. In particular, one type of cytogenetic abnormality is a duplication. Duplications can be of entire chromosomes, or of regions smaller than an entire chromosome. If the region of a chromosome that is contained in a probe is duplicated in a cell, hybridization of a probe to the DNA from the cell will normally produce at least one additional signal as compared to the number of signals present in control cells with no abnormality of the chromosomal region contained in the probe.

Chromosomal probes are labeled so that the chromosomal region to which they hybridize can be detected. Probes typically are directly labeled with a fluorophore, an organic molecule that fluoresces after absorbing light of lower wavelength/higher energy. The fluorophore allows the probe to be visualized without a secondary detection molecule. After covalently attaching a fluorophore to a nucleotide, the nucleotide can be directly incorporated into the probe with standard techniques such as nick translation, random priming, and PCR labeling. Alternatively, deoxycytidine nucleotides within the probe can be transaminated with a linker. The fluorophore then is covalently attached to the transaminated deoxycytidine nucleotides. See, U.S. Pat. No. 5,491,224. U.S. Pat. No. 5,491,224 describes probe labeling as a number of the cytosine residues having a fluorescent label covalently bonded thereto. The number of fluorescently labeled cytosine bases is sufficient to generate a detectable fluorescent signal while the individual so labeled DNA segments essentially retain their specific complementary binding (hybridizing) properties with respect to the chromosome or chromosome region to be detected. Such probes are made by taking the unlabeled DNA probe segment, transaminating with a linking group a number of deoxycytidine nucleotides in the segment, and covalently bonding a fluorescent label to at least a portion of the transaminated deoxycytidine bases.

Probes can also be labeled by nick translation, random primer labeling or PCR labeling. Labeling is done using either fluorescent (direct)- or haptene (indirect)-labeled nucleotides. Representative, non-limiting examples of labels include: AMCA-6-dUTP, CascadeBlue-4-dUTP, Fluorescein-12-dUTP, Rhodamine-6-dUTP, TexasRed-6-dUTP, Cy3-6-dUTP, Cy5-dUTP, Biotin(BIO)-11-dUTP, Digoxygenin(DIG)-11-dUTP and Dinitrophenyl (DNP)-11-dUTP.

Probes also can be indirectly labeled with biotin or digoxygenin, or labeled with radioactive isotopes such as $^{32}P$ and $^{3}H$, although secondary detection molecules or further processing then is required to visualize the probes. For example, a probe labeled with biotin can be detected by avidin conjugated to a detectable marker. For example, avidin can be conjugated to an enzymatic marker such as alkaline phosphatase or horseradish peroxidase. Enzymatic markers can be detected in standard colorimetric reactions using a substrate and/or a catalyst for the enzyme. Catalysts for alkaline phosphatase include 5-bromo-4-chloro-3-indolylphosphate and nitro blue tetrazolium. Diaminobenzoate can be used as a catalyst for horseradish peroxidase.

Probes can also be prepared such that a fluorescent or other label is not part of the DNA before or during the hybridization, and is added after hybridization to detect the probe hybridized to a chromosome. For example, probes can be used that have antigenic molecules incorporated into the DNA. After hybridization, these antigenic molecules are detected using specific antibodies reactive with the antigenic molecules. Such antibodies can themselves incorporate a fluorochrome, or can be detected using a second antibody with a bound fluorochrome.

However, treated or modified, the probe DNA is commonly purified in order to remove unreacted, residual products (e.g., fluorochrome molecules not incorporated into the DNA) before use in hybridization.

Prior to hybridization, chromosomal probes are denatured according to methods well known in the art. Probes can be hybridized or annealed to the chromosomal DNA under hybridizing conditions. "Hybridizing conditions" are conditions that facilitate annealing between a probe and target chromosomal DNA. Since annealing of different probes will vary depending on probe length, base concentration and the like, annealing is facilitated by varying probe concentration, hybridization temperature, salt concentration and other factors well known in the art.

Hybridization conditions are facilitated by varying the concentrations, base compositions, complexities, and lengths of the probes, as well as salt concentrations, temperatures, and length of incubation of a slide. For example, in situ hybridizations are typically performed in hybridization buffer containing 1-2×SSC, 50-65% formamide and blocking DNA to suppress non-specific hybridization. In general, hybridization conditions, as described above, include temperatures of about 25° C. to about 55° C., and incubation lengths of about 0.5 hours to about 96 hours.

Non-specific binding of chromosomal probes to DNA outside of the target region can be removed by a series of washes to a slide. Temperature and concentration of salt in each wash are varied to control stringency of the washes. For example, for high stringency conditions, washes can be carried out at about 65° C. to about 80° C., using 0.2× to about 2×SSC, and about 0.1% to about 1% of a non-ionic detergent such as Nonidet P-40 (NP40). Stringency can be lowered by decreasing the temperature of the washes or by increasing the concentration of salt in the washes. In some applications it is necessary to block the hybridization capacity of repetitive sequences. Thus, in some embodiments, tRNA, human genomic DNA, or Cot-I DNA is used to block non-specific hybridization. After washing, the slide is allowed to drain and air dry, then mounting medium, a counterstain such as DAPI, and a coverslip are applied to the slide. Slides can be viewed immediately or stored at −20° C. before examination.

For fluorescent probes used in fluorescence in situ hybridization (FISH) techniques, fluorescence can be viewed with a fluorescence microscope equipped with an appropriate filter for each fluorophore, or by using dual or triple band-pass filter sets to observe multiple fluorophores. See, for example, U.S. Pat. No. 5,776,688. Alternatively, techniques such as flow cytometry can be used to examine the hybridization pattern of the chromosomal probes.

In array-based comparative genomic hybridization (CGH) methods, a first collection of nucleic acids (e.g., from a sample, e.g., a possible tumor) is labeled with a first label, while a second collection of nucleic acids (e.g., a control, e.g., from a healthy cell/tissue) is labeled with a second label. The ratio of hybridization of the nucleic acids is determined by the ratio of the two (first and second) labels binding to each fiber in the array. Where there are chromosomal deletions or multiplications, differences in the ratio of the signals from the two labels will be detected and the ratio will provide a measure of the copy number. Array-based CGH can also be performed with single-color labeling (as opposed to labeling the control and the possible tumor sample with two different dyes and mixing them prior to hybridization, which will yield a ratio due to competitive hybridization of probes on the arrays). In single color CGH, the control is labeled and hybridized to one array and absolute signals are read, and the possible tumor sample is labeled and hybridized to a second array (with identical content) and absolute signals are read. Copy number difference is calculated based on absolute signals from the two arrays.

Hybridization protocols suitable for use with the methods featured in the disclosure are described, e.g., in Albertson (1984) *EMBO J.* 3: 1227-1234; Pinkel (1988) *Proc. Natl. Acad. Sci. USA* 85: 9138-9142; EPO Pub. No. 430,402; *Methods in Molecular Biology, Vol.* 33: In situ Hybridization Protocols, Choo, ed., Humana Press, Totowa, N.J. (1994), etc., the contents of each of which are incorporated herein by reference. In one embodiment, the hybridization protocol of Pinkel, et al. (1998) *Nature Genetics* 20: 207-211, or of Kallioniemi (1992) *Proc. Natl Acad Sci USA* 89:5321-5325 (1992) is used, the contents of each of which are incorporated herein by reference. Array-based CGH is described in U.S. Pat. No. 6,455,258, the contents of which are incorporated herein by reference.

In still another embodiment, amplification-based assays can be used to measure presence/absence and copy number. In such amplification-based assays, the nucleotide sequences act as a template in an amplification reaction (e.g., Polymerase Chain Reaction (PCR). In a quantitative amplification, the amount of amplification product will be proportional to the amount of template in the original sample. Comparison to appropriate controls, e.g., healthy tissue, provides a measure of the copy number.

Methods of "quantitative" amplification are well known to those of skill in the art. For example, quantitative PCR involves simultaneously co-amplifying a known quantity of a control sequence and an experimental sequence using the same primers. Amplifying a control sequence provides an internal standard that can be used to calibrate the PCR reaction. Detailed protocols for quantitative PCR are provided in Innis, et al. (1990) PCR Protocols, *A Guide to Methods and Applications*, Academic Press, Inc. N.Y, the contents of each of which are incorporated herein by reference. Measurement of DNA copy number at microsatellite loci using quantitative PCR analysis is described in Ginzonger, et al. (2000) *Cancer Research* 60:5405-5409, the contents of which are incorporated herein by reference. The known nucleotide sequence for genes is sufficient to enable one of skill in the art to routinely select primers to amplify any portion of the gene. Fluorogenic quantitative PCR can also be used. In fluorogenic quantitative PCR, quantitation is based on amount of fluorescence signals, e.g., TaqMan and sybr green.

Other suitable amplification methods include, e.g., ligase chain reaction (LCR) (see Wu and Wallace (1989) *Genomics* 4: 560, Landegren, et al. (1988) *Science* 241:1077, and Barringer et al. (1990) *Gene* 89: 117), transcription amplification (Kwoh, et al. (1989) *Proc. Natl. Acad. Sci. USA* 86: 1173), self-sustained sequence replication (Guatelli, et al. (1990) *Proc. Nat. Acad. Sci. USA* 87: 1874), dot PCR, and linker adapter PCR, etc., the contents of each of which are incorporated herein by reference.

Method of Evaluating Cancer or Subject

In another aspect, the disclosure features a method of evaluating a subject (e.g., a patient), e.g., for risk of having or developing a cancer, e.g., carcinosarcoma (e.g., ovarian carcinosarcoma), melanoma (e.g., vaginal melanoma), carcinoma, fibrosarcoma, a salivary gland tumor, histiocytosis, a thyroid tumor, a soft tissue sarcoma, or chondrosarcoma, or a cancer provided in Tables E, J, or O. The method includes acquiring information or knowledge of the presence of a fusion nucleic acid molecule or polypeptide as described herein in a subject (e.g., acquiring genotype information of the subject that identifies a fusion nucleic acid molecule as being present in the subject).

In some embodiments, the method comprises acquiring a nucleotide or amino acid sequence for a fusion nucleic acid molecule or polypeptide described herein. In some embodiments, the method comprises detecting the presence of a fusion nucleic acid molecule or polypeptide in the subject. In some embodiments, the presence of the fusion nucleic acid molecule or polypeptide is positively correlated with increased risk for, or having, a cancer associated with such a fusion nucleic acid molecule or polypeptide.

The method can further include acquiring, e.g., directly or indirectly, a sample from a patient and evaluating the sample for the presence of a fusion molecule described herein.

The method can further include the step(s) of identifying (e.g., evaluating, diagnosing, screening, and/or selecting) the subject as being positively correlated with increased risk for, or having, a cancer associated with the fusion molecule.

In another embodiment, a subject identified as having a fusion molecule described herein is identified or selected as likely or unlikely to respond to a treatment, e.g., a kinase inhibitor treatment as described herein. The method can further include treating the subject with a kinase inhibitor, e.g., a kinase inhibitor as described herein.

In certain embodiments, the subject is a patient or patient population that has participated in a clinical trial. In one embodiment, the subject has participated in a clinical trial for evaluating a kinase inhibitor (e.g., a multi-kinase inhibitor or a specific kinase inhibitor). In one embodiment, the clinical trial is discontinued or terminated. In one embodiment, the subject responded favorably to the clinical trial or treatment administered in the clinical trial, e.g., experienced an improvement in at least one symptom of a cancer (e.g., decreased tumor size, decreased rate of tumor growth, or increased survival). In other embodiments, the subject did not respond in a detectable way to the clinical trial or treatment administered in the clinical trial.

In certain embodiments, the method further comprises determining clinical trial eligibility for a subject. In one embodiment, the subject is evaluated for the presence or absence of a fusion molecule described herein. In one embodiment, a subject identified as having a fusion molecule described herein is selected for clinical trial eligibility.

Subjects, e.g., patients, can be evaluated for the presence of a fusion molecule described herein. A patient can be evaluated, for example, by determining the genomic sequence of the patient, e.g., by an NGS method. Alternatively, or in addition, evaluation of a patient can include directly assaying for the presence of a fusion molecule described herein, in the patient, such as by an assay to detect a fusion nucleic acid (e.g., DNA or RNA), such as by, Southern blot, Northern blot, or RT-PCR, e.g., qRT-PCR. Alternatively, or in addition, a patient can be evaluated for the presence of a fusion protein described herein, such as by immunohistochemistry, Western blot, immunoprecipitation, or immunomagnetic bead assay.

Evaluation of a patient can also include a cytogenetic assay, such as by fluorescence in situ hybridization (FISH), to identify the chromosomal rearrangement resulting in the fusion. FISH is commonly used to evaluate patient tumor samples for the presence of chromosomal aberrations that result in gene fusions (Davies, K. D., et al. *Clin Cancer Res* 18, 4570-4579 (2012); Kwak, E. L., et al. *N Engl J Med* 363, 1693-1703 (2010)). For example, to perform FISH, at least a first probe tagged with a first detectable label can be designed to target MEX3A, such as in one or more exons of MEX3A and at least a second probe tagged with a second detectable label can be designed to target NTRK1, such as in one or more exons of NTRK1 (e.g., the exons containing the part of the protein that includes the tyrosine kinase domain). The at least one first probe and the at least one second probe will be closer together in patients who carry the MEX3A-NTRK1 fusion than in patients who do not carry the fusion.

In other embodiments, to perform FISH, at least a first probe tagged with a first detectable label can be designed to target CARM1, such as in one or more exons of CARM1 and at least a second probe tagged with a second detectable label can be designed to target NTRK3, such as in one or more exons of NTRK3 (e.g., the exons containing the part of the protein that includes the tyrosine kinase domain). The at least one first probe and the at least one second probe will be closer together in patients who carry the CARM1-NTRK3 fusion than in patients who do not carry the fusion.

In other embodiments, to perform FISH, at least a first probe tagged with a first detectable label can be designed to target a gene provided in Table A, such as in one or more exons of a gene provided in Table A and at least a second probe tagged with a second detectable label can be designed to target NTRK1, such as in one or more exons of NTRK1 (e.g., the exons containing the part of the protein that includes the tyrosine kinase domain). The at least one first probe and the at least one second probe will be closer together in patients who carry an NTRK1 fusion than in patients who do not carry the fusion.

In other embodiments, to perform FISH, at least a first probe tagged with a first detectable label can be designed to target a gene provided in Table F, such as in one or more exons of a gene provided in Table F and at least a second probe tagged with a second detectable label can be designed to target NTRK2, such as in one or more exons of NTRK2 (e.g., the exons containing the part of the protein that includes the tyrosine kinase domain). The at least one first probe and the at least one second probe will be closer together in patients who carry an NTRK2 fusion than in patients who do not carry the fusion.

In other embodiments, to perform FISH, at least a first probe tagged with a first detectable label can be designed to target a gene provided in Table K, such as in one or more exons of a gene provided in Table K and at least a second probe tagged with a second detectable label can be designed to target NTRK3, such as in one or more exons of NTRK3 (e.g., the exons containing the part of the protein that includes the tyrosine kinase domain). The at least one first probe and the at least one second probe will be closer together in patients who carry an NTRK3 fusion than in patients who do not carry the fusion.

Other embodiments include a break-apart FISH assay to detect chromosomal rearrangements within the NTRK1 gene, regardless of the identity of the other fusion partner. In such assays, at least a first probe tagged with a first detectable label can be designed to target NTRK1 (or MEX3A), such as in one or more exons of NTRK1 (or MEX3A) and at least a second probe tagged with a second detectable label can be designed to target NTRK1 (or MEX3A). Hybridization of these probes can show a separation of the 5' and 3' probes in the samples containing the MEX3A-NTRK1 gene fusions, but not in a control sample having intact full length NTRK1 (or MEX3A).

Other embodiments include a break-apart FISH assay to detect chromosomal rearrangements within the NTRK3 gene, regardless of the identity of the other fusion partner. In such assays, at least a first probe tagged with a first detectable label can be designed to target NTRK3 (or CARM1), such as in one or more exons of NTRK3 (or MEX3A) and at least a second probe tagged with a second detectable label can be designed to target NTRK3 (or CARM1). Hybridization of these probes can show a separation of the 5' and 3' probes in the samples containing the CARM1-NTRK3 gene fusions, but not in a control sample having intact full length NTRK3 (or CARM1).

Other embodiments include a break-apart FISH assay to detect chromosomal rearrangements within the NTRK1 gene, regardless of the identity of the other fusion partner. In such assays, at least a first probe tagged with a first detectable label can be designed to target NTRK1 (or a gene provided in Table A), such as in one or more exons of NTRK1 (or of a gene provided in Table A) and at least a second probe tagged with a second detectable label can be designed to target NTRK1 (or a gene provided in Table A). Hybridization of these probes can show a separation of the 5' and 3' probes in the samples containing an NTRK1 fusion, but not in a control sample having intact full length NTRK1 (or a gene provided in Table A).

Other embodiments include a break-apart FISH assay to detect chromosomal rearrangements within the NTRK2 gene, regardless of the identity of the other fusion partner. In such assays, at least a first probe tagged with a first detectable label can be designed to target NTRK2 (or a gene provided in Table F), such as in one or more exons of NTRK2 (or of a gene provided in Table F) and at least a second probe tagged with a second detectable label can be designed to target NTRK2 (or a gene provided in Table F). Hybridization of these probes can show a separation of the 5' and 3' probes in the samples containing an NTRK2 fusion, but not in a control sample having intact full length NTRK2 (or a gene provided in Table F).

Other embodiments include a break-apart FISH assay to detect chromosomal rearrangements within the NTRK3 gene, regardless of the identity of the other fusion partner. In such assays, at least a first probe tagged with a first detectable label can be designed to target NTRK3 (or a gene provided in Table K), such as in one or more exons of NTRK3 (or of a gene provided in Table K) and at least a second probe tagged with a second detectable label can be designed to target NTRK3 (or a gene provided in Table K). Hybridization of these probes can show a separation of the 5' and 3' probes in the samples containing an NTRK3 fusion, but not in a control sample having intact full length NTRK3 (or a gene provided in Table K).

In one embodiment, the results of a clinical trial, e.g., a successful or unsuccessful clinical trial, can be repurposed to identify agents that target a fusion molecule described herein. By one exemplary method, a candidate agent used in a clinical trial can be reevaluated to determine if the agent in the trial targets a fusion or is effective to treat a tumor containing a particular fusion. For example, subjects who participated in a clinical trial for an agent, such as a kinase inhibitor, can be identified. Patients who experienced an improvement in symptoms, e.g., cancer (e.g., lung cancer) symptoms, such as decreased tumor size, or decreased rate of tumor growth, can be evaluated for the presence of a fusion molecule described herein. Patients who did not experience an improvement in cancer symptoms can also be evaluated for the presence of a fusion molecule described herein. Where patients carrying a fusion molecule described herein are found to have been more likely to respond to the test agent than patients who did not carry such a fusion, then the agent is determined to be an appropriate treatment option for a patient carrying the fusion.

"Reevaluation" of patients can include, for example, determining the genomic sequence of the patients, or a subset of the clinical trial patients, e.g., by an NGS method. Alternatively, or in addition, reevaluation of the patients can include directly assaying for the presence of a fusion molecule described herein, in the patient, such as by an assay to detect a fusion nucleic acid (e.g., RNA or DNA), such as by RT-PCR, e.g., qRT-PCR. Alternatively, or in addition, a patient can be evaluated for the presence of a protein fusion, such as by immunohistochemistry, Western blot, immunoprecipitation, or immunomagnetic bead assay.

Clinical trials suitable for repurposing as described above include trials that tested tyrosine kinase inhibitors or multikinase inhibitors.

In a related aspect, a method of evaluating a patient or a patient population is provided. The method includes: identifying, selecting, or obtaining information or knowledge that the patient or patient population has participated in a clinical trial; acquiring information or knowledge of the presence of a fusion nucleic acid molecule or polypeptide described herein in the patient or patient population (e.g., acquiring genotype information of the subject that identifies a fusion nucleic acid molecule described herein as being present in the subject); acquiring a nucleotide or amino acid sequence for a fusion nucleic acid molecule or polypeptide described herein; or detecting the presence of a fusion nucleic acid molecule or polypeptide described herein, in the subject, wherein the presence of the fusion identifies the patient or patient population as having an increased risk for, or having, a cancer associated with the fusion molecule. In some embodiments, the method further includes treating the subject with an anti-cancer agent, e.g., a kinase inhibitor, e.g., a kinase inhibitor as described herein.

In certain embodiments, the method further comprises determining clinical trial eligibility for a patient or patient population. In one embodiment, the patient or patient population is evaluated for the presence or absence of a fusion molecule described herein. In one embodiment, patient or patient population identified as having a fusion molecule described herein is selected for clinical trial eligibility.

Reporting

Methods described herein can include providing a report, such as, in electronic, web-based, or paper form, to the patient or to another person or entity, e.g., a caregiver, e.g., a physician, e.g., an oncologist, a hospital, clinic, third-party payor, insurance company or government entity. The report can include output from the method, e.g., the indication of the presence or absence of a fusion molecule described herein or wildtype sequence. In one embodiment, a report is generated, such as in paper or electronic form, which identifies the presence or absence of an alteration described herein, and optionally includes an identifier for the patient from which the sequence was obtained.

The report can also include information on the role of a fusion molecule described herein, or wildtype sequence, in disease. Such information can include information on prognosis, resistance, or potential or suggested therapeutic options. The report can include information on the likely effectiveness of a therapeutic option, the acceptability of a therapeutic option, or the advisability of applying the therapeutic option to a patient, e.g., a patient having a sequence, alteration or mutation identified in the test, and in some embodiments, identified in the report. For example, the report can include information, or a recommendation on, the administration of a drug, e.g., the administration at a dosage or in a treatment regimen, e.g., in combination with other drugs, to the patient. In an embodiment, not all mutations identified in the method are identified in the report. For example, the report can be limited to disclosing mutations in genes having a level of correlation with the occurrence, prognosis, stage, or susceptibility of a cancer to a treatment, e.g., with a therapeutic option. The report can be delivered, e.g., to an entity described herein, within about or approximately 7, 14, or 21 days from receipt of the sample by an entity practicing the method of providing a report.

In another aspect, the disclosure features a method for generating a report, e.g., a personalized cancer treatment report, by obtaining a sample, e.g., a tumor sample, from a subject, and detecting a fusion molecule described herein in the sample. In one embodiment, a report is generated that annotates a selected treatment, or that lists, e.g., in order of preference, two or more treatment options based on the mutation identified. In another embodiment, the subject, e.g., a patient, is further administered one or both of the treatment options.

Therapeutic Methods

Methods of treating a neoplasm, a cancer, or a tumor harboring a fusion nucleic acid molecule or polypeptide described herein are disclosed. The methods include administering an anti-cancer agent, e.g., a kinase inhibitor as described herein, alone or in combination, e.g., in combination with other agents, e.g., chemotherapeutic agents, or procedures, in an amount sufficient to reduce or inhibit tumor cell growth, and/or treat or prevent the cancer(s), in the subject.

"Treat," "treatment," and other forms of this word refer to the administration of a kinase inhibitor, alone or in combination with a second agent or a different therapeutic modality to impede growth of a cancer, to cause a cancer to shrink by weight or volume, to extend the expected survival time of the subject and or time to progression of the tumor or the like. In those subjects, treatment can include, but is not limited to, inhibiting tumor growth, reducing tumor mass, reducing size or number of metastatic lesions, inhibiting the development of new metastatic lesions, prolonged survival, prolonged progression-free survival, prolonged time to progression, and/or enhanced quality of life.

As used herein, unless otherwise specified, the terms "prevent," "preventing" and "prevention" contemplate an action that occurs before a subject begins to suffer from the re-growth of a cancer and/or which inhibits or reduces the severity of the cancer.

As used herein, and unless otherwise specified, a "therapeutically effective amount" of an agent is an amount sufficient to provide a therapeutic benefit in the treatment or management of a cancer, or to delay or minimize one or more symptoms associated with the cancer. A therapeutically effective amount of an agent means an amount of the agent, alone or in combination with other therapeutic agents, which provides a therapeutic benefit in the treatment or management of the cancer. The term "therapeutically effective amount" can encompass an amount that improves overall therapy, reduces or avoids symptoms or causes of the cancer, or enhances the therapeutic efficacy of another therapeutic agent or another therapeutic modality.

As used herein, and unless otherwise specified, a "prophylactically effective amount" of an agent is an amount sufficient to prevent re-growth of the cancer, or one or more symptoms associated with the cancer, or prevent its recurrence. A prophylactically effective amount of an agent means an amount of the agent, alone or in combination with other therapeutic agents or therapeutic modalities, which provides a prophylactic benefit in the prevention of the cancer. The term "prophylactically effective amount" can encompass an amount that improves overall prophylaxis or enhances the prophylactic efficacy of another prophylactic agent.

As used herein, the term "patient" or "subject" refers to an animal, typically a human (i.e., a male or female of any age group, e.g., a pediatric patient (e.g., infant, child, adolescent) or adult patient (e.g., young adult, middle-aged adult or senior adult) or other mammal, such as a primate (e.g., cynomolgus monkey, rhesus monkey). When the term is used in conjunction with administration of an agent or drug, then the patient has been the object of treatment, observation, and/or administration of the agent or drug.

In certain embodiments, the neoplasm or neoplastic cell is a benign, pre-malignant, malignant (cancer) or metastasis.

In certain embodiments, the cancer includes, but is not limited to, a solid tumor, a soft tissue tumor, and a metastatic lesion (e.g., a cancer as described herein). In one embodiment, the cancer is chosen from ovarian cancer, lung cancer, thyroid cancer, colorectal cancer, adenocarcinoma, melanoma, B cell cancer, breast cancer, bronchus cancer, cancer of the oral cavity or pharynx, cancer of hematological tissues, cervical cancer, colon cancer, esophageal cancer, esophageal-gastric cancer, gastric cancer, kidney cancer, liver cancer, multiple myeloma, ovarian cancer, pancreatic cancer, prostate cancer, salivary gland cancer, small bowel or appendix cancer, stomach cancer, testicular cancer, urinary bladder cancer, uterine or endometrial cancer, inflammatory myofibroblastic tumors, gastrointestinal stromal tumor (GIST), and the like. Exemplary cancers that can be treated include, e.g., ovarian carcinosarcoma, vaginal melanoma, lung adenocarcinoma, cervical adenocarcinoma, uterus endometrial adenocarcinoma, glioblastoma, melanoma, spindle cell sarcoma, ameloblastic fibroscarcoma, adenocarcinoma, cholangiocarcinoma, urothelial (transitional cell) carcinoma, ovarian epithelial carcinoma, colorectal adenocarcinoma, breast carcinoma, prostate carcinoma, and pancreas ductal adenocarcinoma. In some embodiments, the ovarian cancer is ovarian carcinosarcoma. In some embodiments, the melanoma is vaginal melanoma. In some embodiments, the cancer is chosen from ovarian carcinosarcoma, vaginal melanoma, salivary gland mammary analogue secretory carcinoma, soft tissue fibrosarcoma, a salivary gland tumor, histiocytosis, a thyroid tumor, a soft tissue sarcoma, or chondrosarcoma.

In certain embodiments, the cancer includes, but is not limited to an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, or a brain medulloblastoma. In certain embodiments, the cancer includes, but is not limited to a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, or a colon adenocarcinoma. In certain embodiments, the cancer is a colorectal cancer, and the colorectal cancer comprises high microsatellite instability. In certain embodiments, the cancer includes, but is not limited to a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, or a salivary gland carcinoma. In certain embodiments, the cancer does not have an alteration in one or more of ALK, BRAF, ERBB2, EGFR, ROS1, or KRAS. In certain embodiments, the cancer has no detectable altered level or activity in one or more of EGFR, KRAS, ALK, ROS1 or RET. In certain embodiments, the cancer has a tumor mutation burden of 20 mut/mB or more.

In yet other embodiments, the lung cancer is chosen from one or more of the following: non-small cell lung cancer (NSCLC), small cell lung cancer (SCLC), squamous cell carcinoma (SCC), adenocarcinoma of the lung, bronchogenic carcinoma, a lung carcinoid tumor, large cell carcinoma, a lung neuroendocrine tumor, or a combination thereof. In one embodiment, the lung cancer is NSCLC or SCC. In another embodiment, the cancer is a lung cancer (e.g., lung adenocarcinoma) that has an alteration in NTRK, e.g., has a MEX3A-NTRK1 molecule described herein. In another embodiment, the cancer is a lung cancer (e.g., lung adenocarcinoma) that has no detectable altered level or activity in one or more of EGFR, KRAS, ALK, ROS1 or RET.

In some embodiments, the cancer is an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, or a brain medulloblastoma that has an alteration in the NTRK1 gene or in a gene of Table A, e.g., has an NTRK1 fusion nucleic acid molecule or polypeptide described herein (e.g., in Tables C, D, or E). In some embodiments, the colorectal cancer comprises high microsatellite instability. In some embodiments, the cancer does not have an alteration in one or more of ALK, BRAF, ERBB2, EGFR, ROS1, or KRAS. In some embodiments, the cancer has no detectable altered level or activity in one or more of EGFR, KRAS, ALK, ROS1 or RET. In some embodiments, the cancer comprises a tumor mutation burden of 20 mut/mB or more.

In some embodiments, the cancer is a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, or a colon adenocarcinoma that has an alteration in the NTRK2 gene or in a gene of Table F, e.g., has an NTRK2 fusion nucleic acid molecule or polypeptide described herein (e.g., in Tables H, I, or J). In some embodiments, the colorectal cancer comprises high microsatellite instability. In some embodiments, the cancer does not have an alteration in one or more of ALK, BRAF, ERBB2, EGFR, ROS1, or KRAS. In some embodiments, the cancer has no detectable altered level or activity in one or more of EGFR, KRAS, ALK, ROS1 or RET. In some embodiments, the cancer comprises a tumor mutation burden of 20 mut/mB or more.

In some embodiments, the cancer is a melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma that has an alteration in the NTRK3 gene or in a gene of Table K, e.g., has an NTRK3 fusion nucleic acid molecule or polypeptide described herein (e.g., in Tables M, N, or O). In some embodiments, the cancer does not have an alteration in one or more of ALK, BRAF, ERBB2, EGFR, ROS1, or KRAS. In some embodiments, the cancer has no detectable altered level or activity in one or more of EGFR, KRAS, ALK, ROS1 or RET. In some embodiments, the cancer comprises a tumor mutation burden of 20 mut/mB or more.

In another aspect, the disclosure features a method of treating a subject with a kinase inhibitor, wherein the subject has a cancer (e.g., an ovarian cancer, e.g., an ovarian carcinosarcoma), and wherein the kinase inhibitor inhibits Neurotrophic tyrosine kinase receptor type 1 (NTRK1), the method comprising the steps of: determining whether the subject has a nucleic acid molecule that encodes a MEX3A-NTRK1 fusion polypeptide described herein, or a breakpoint comprising a fragment thereof by: obtaining a biological sample from the subject; and performing an assay on the biological sample to determine if the subject has the nucleic acid molecule; and if the subject has the nucleic acid molecule, then administering the kinase inhibitor to the subject.

In another aspect, the disclosure features a method of treating a subject with a kinase inhibitor, wherein the subject has a cancer (e.g., an ovarian cancer, e.g., an ovarian carcinosarcoma), and wherein the kinase inhibitor inhibits Neurotrophic tyrosine kinase receptor type 3 (NTRK3), the method comprising the steps of: determining whether the subject has a nucleic acid molecule that encodes a CARM1-NTRK3 fusion polypeptide described herein, or a breakpoint comprising a fragment thereof by: obtaining a biological sample from the subject; and performing an assay on the biological sample to determine if the subject has the nucleic acid molecule; and if the subject has the nucleic acid molecule, then administering the kinase inhibitor to the subject.

In another aspect, the disclosure features a method of treating a subject with a kinase inhibitor, wherein the subject has a cancer (e.g., a cancer provided in Table E), and wherein the kinase inhibitor inhibits Neurotrophic tyrosine kinase receptor type 1 (NTRK1), the method comprising the steps of: determining whether the subject has a nucleic acid molecule that encodes an NTRK1 fusion polypeptide described herein, or a breakpoint comprising a fragment thereof by: obtaining a biological sample from the subject; and performing an assay on the biological sample to determine if the subject has the nucleic acid molecule; and if the subject has the nucleic acid molecule, then administering the kinase inhibitor to the subject.

In another aspect, the disclosure features a method of treating a subject with a kinase inhibitor, wherein the subject has a cancer (e.g., a cancer provided in Table J), and wherein the kinase inhibitor inhibits Neurotrophic tyrosine kinase receptor type 2 (NTRK2), the method comprising the steps of: determining whether the subject has a nucleic acid molecule that encodes an NTRK2 fusion polypeptide described herein, or a breakpoint comprising a fragment thereof by: obtaining a biological sample from the subject; and performing an assay on the biological sample to determine if the subject has the nucleic acid molecule; and if the subject has the nucleic acid molecule, then administering the kinase inhibitor to the subject.

In another aspect, the disclosure features a method of treating a subject with a kinase inhibitor, wherein the subject has a cancer (e.g., a cancer provided in Table O), and wherein the kinase inhibitor inhibits Neurotrophic tyrosine kinase receptor type 3 (NTRK3), the method comprising the steps of: determining whether the subject has a nucleic acid molecule that encodes an NTRK3 fusion polypeptide described herein, or a breakpoint comprising a fragment thereof by: obtaining a biological sample from the subject; and performing an assay on the biological sample to determine if the subject has the nucleic acid molecule; and if the subject has the nucleic acid molecule, then administering the kinase inhibitor to the subject.

Non-limiting examples of cancers to be treated by the methods of the present disclosure can include melanoma (e.g., metastatic malignant melanoma), renal cancer (e.g. clear cell carcinoma), prostate cancer (e.g. hormone refractory prostate adenocarcinoma), pancreatic adenocarcinoma, breast cancer, colon cancer, lung cancer (e.g. non-small cell lung cancer), esophageal cancer, head and neck cancer, squamous cell carcinoma, liver cancer, ovarian cancer, cervical cancer, thyroid cancer, glioblastoma, glioma, leukemia, lymphoma, mesothelioma, sarcoma and other neoplastic malignancies. Additionally, the invention includes refractory or recurrent malignancies whose growth may be inhibited using the methods of the invention. In some embodiments, a cancer to be treated by the methods of the present disclosure include, for example, carcinoma, squamous carcinoma (for example, cervical canal, eyelid, tunica conjunctiva, vagina, lung, oral cavity, skin, urinary bladder, head and neck, tongue, larynx, and gullet), and adenocarcinoma (for example, prostate, small intestine, endometrium, cervical canal, large intestine, lung, pancreas, gullet, intestinum rectum, uterus, stomach, mammary gland, and ovary). In some embodiments, a cancer to be treated by the methods of the present disclosure further include sarcomata (for example, myogenic sarcoma), leukosis, neuroma, melanoma, and lymphoma. In some embodiments, a cancer is a melanoma, renal cell carcinoma, lung cancer, bladder cancer, breast cancer, cervical cancer, colon cancer, gall bladder cancer, laryngeal cancer, liver cancer, thyroid cancer, stomach cancer, salivary gland cancer, prostate cancer, pancreatic cancer, or Merkel cell carcinoma (see, e.g., Bhatia et al, *Curr. Oncol. Rep.,* 13(6): 488-497 (2011)).

In embodiments, a cancer is acute myeloid leukemia ("AML"), acute lymphoblastic leukemia ("ALL"), adenocarcinoma, adenocarcinoma of the lung, adrenocortical carcinoma, anal cancer (e.g., squamous cell carcinoma of the anus), appendiceal cancer, B-cell derived leukemia, B-cell derived lymphoma, bladder cancer, brain cancer, breast cancer (e.g., triple negative breast cancer (TNBC) or non-triple negative breast cancer), cancer of the fallopian tube(s), cancer of the testes, cerebral cancer, cervical cancer (e.g., squamous cell carcinoma of the cervix), cholangiocarcinoma, choriocarcinoma, chronic myelogenous leukemia, a CNS tumor, colon adenocarcinoma, colon cancer or colorectal cancer (e.g., colon adenocarcinoma), diffuse intrinsic pontine glioma (DIPG), diffuse large B cell lymphoma ("DLBCL"), embryonal rhabdomyosarcoma (ERMS), endometrial cancer, epithelial cancer, esophageal cancer (e.g., squamous cell carcinoma of the esophagus), Ewing's sarcoma, eye cancer (e.g., uveal melanoma), follicular lymphoma ("FL"), gall bladder cancer, gastric cancer, gastrointestinal cancer, glioblastoma multiforme, glioma (e.g., lower grade glioma), head and neck cancer (e.g., squamous cell carcinoma of the head and neck (SCHNC)), a hematological cancer, hepatocellular cancer, Hodgkin's lymphoma (HL)/primary mediastinal B-cell lymphoma, kidney cancer (e.g., kidney clear cell cancer, kidney papillary cancer, or kidney chromophobe cancer), large B-cell lymphoma, laryngeal cancer, leukemia, liver cancer, lung cancer (e.g., non-small cell lung cancer (NSCLC), small cell lung cancer, lung adenocarcinoma, or squamous cell carcinoma of the lung), lymphoma, melanoma, Merkel cell carcinoma, mesothelioma, monocytic leukemia, multiple myeloma, myeloma, a neuroblastic-derived CNS tumor (e.g., neuroblastoma (NB)), non-Hodgkin's lymphoma (NHL), non-small cell lung cancer (NSCLC), oral cancer, osteosarcoma, ovarian cancer, ovarian carcinoma, pancreatic cancer, peritoneal cancer, pheocromocytoma, primary peritoneal cancer, prostate cancer, relapsed or refractory classic Hodgkin's Lymphoma (cHL), renal cancer (e.g., renal cell carcinoma), rectal cancer (rectum carcinoma), salivary gland cancer (e.g., a salivary gland tumor), sarcoma, skin cancer, small cell lung cancer, small intestine cancer, squamous cell carcinoma of the penis, soft tissue sarcoma, squamous cell carcinoma of the esophagus, squamous cell carcinoma of the head and neck (SCHNC), squamous cell carcinoma of the lung, stomach cancer, T-cell derived leukemia, T-cell derived lymphoma, testicular tumor, thymic cancer, a thymoma, thyroid cancer (thyroid carcinoma), uveal melanoma, urothelial cell carcinoma, uterine cancer (e.g., uterine endometrial cancer or uterine sarcoma such as uterine carcinosarcoma), vaginal cancer (e.g., squamous cell carcinoma of the vagina), vulvar cancer (e.g., squamous cell carcinoma of the vulva), or Wilms tumor.

In embodiments, a cancer is adenocarcinoma, endometrial cancer, breast cancer, ovarian cancer, cervical cancer, fallopian tube cancer, testicular cancer, primary peritoneal cancer, colon cancer, colorectal cancer, stomach cancer, small intestine cancer, squamous cell carcinoma of the anus, squamous cell carcinoma of the penis, squamous cell carcinoma of the cervix, squamous cell carcinoma of the vagina, squamous cell carcinoma of the vulva, soft tissue sarcoma, melanoma, renal cell carcinoma, lung cancer, non-small cell lung cancer, adenocarcinoma of the lung, squamous cell carcinoma of the lung, stomach cancer, bladder cancer, gall bladder cancer, liver cancer, thyroid cancer, laryngeal cancer, salivary gland cancer, esophageal cancer, head and neck cancer, squamous cell carcinoma of the head and neck, prostate cancer, pancreatic cancer, mesothelioma, Merkel cell carcinoma, sarcoma, glioblastoma, a hematological cancer, multiple myeloma, B-cell lymphoma, T-cell lymphoma, Hodgkin's lymphoma/primary mediastinal B-cell lymphoma, chronic myelogenous leukemia, acute myeloid leukemia, acute lymphoblastic leukemia, non-Hodgkin's lymphoma, neuroblastoma, a CNS tumor, diffuse intrinsic pontine glioma (DIPG), Ewing's sarcoma, embryonal rhabdomyosarcoma, osteosarcoma, or Wilms tumor. In embodiments, the cancer is MSS or MSI-L, is characterized by microsatellite instability, is MSI-H, has high TMB, has high TMB and is MSS or MSI-L, has high TMB and is MSI-H, has a defective DNA mismatch repair system, has a defect in a DNA mismatch repair gene, is a hypermutated cancer, is an HRD or HRR cancer, comprises a mutation in polymerase delta (POLD), or comprises a mutation in polymerase epsilon (POLE).

In embodiments, a cancer is large B-cell lymphoma, thymoma, acute myeloid leukemia, testicular tumor, lung adenocarcinoma, non-small cell lung cancer, kidney clear cell cancer, breast cancer, triple negative breast cancer (TNBC), non-triple negative breast cancer (non-TNBC), gastric cancer, lung squamous cell cancer, mesothelioma, pancreatic cancer, cervical cancer, head and neck cancer, melanoma, hepatocellular carcinoma, nasopharyngeal cancer, esophageal cancer, colon adenocarcinoma, colorectal cancer, rectum carcinoma, cholangiocarcinoma, uterine endometrial cancer, sarcoma, bladder cancer, thyroid carcinoma, kidney papillary cancer, glioblastoma multiforme, liver cancer, uterine carcinosarcoma, pheocromocytoma, lower grade glioma, kidney chromophobe, adrenocortical cancer, or uveal melanoma.

In other embodiments, a cancer is a head and neck cancer, a lung cancer (e.g., a non-small cell lung cancer (NSCLC)), a renal cancer, a bladder cancer, a melanoma, Merkel cell carcinoma, a cervical cancer, a vaginal cancer, a vulvar cancer, a uterine cancer, a endometrial cancer, an ovarian cancer, a fallopian tube cancer, a breast cancer, a prostate cancer, a salivary gland tumor, a thymoma, a adrenocortical carcinoma, a esophageal cancer, a gastric cancer, a colorectal cancer, an appendiceal cancer, a urothelial cell carcinoma, or a squamous cell carcinoma (e.g., of the lung; of the anogenital region including anus, penis, cervix, vagina, or vulva; or of the esophagus).

In some embodiments, a cancer for treatment in the context of the present disclosure is a melanoma, renal cell carcinoma, lung cancer, bladder cancer, breast cancer, cervical cancer, colon cancer, gall bladder cancer, laryngeal cancer, liver cancer, thyroid cancer, stomach cancer, salivary gland cancer, prostate cancer, pancreatic cancer, or Merkel cell carcinoma.

In embodiments a cancer is a lymphoma such as Hodgkin's disease, non-Hodgkin's Lymphoma, Multiple myeloma, Waldenstrom's macroglobulinemia, Heavy chain disease and Polycythemia vera.

In embodiments, a cancer is a squamous cell carcinoma. In embodiments, a cancer is squamous cell carcinoma of the lung. In embodiments, a cancer is squamous cell carcinoma of the esophagus. In embodiments, a cancer is squamous cell carcinoma of the anogenital region (e.g., of the anus, penis, cervix, vagina, or vulva). In embodiments, a cancer is head and neck squamous cell carcinoma (HNSCC).

In embodiments, a cancer is bladder cancer, breast cancer (e.g., triple negative breast cancer (TNBC)), cancer of the fallopian tube(s), cholagiocarcinoma, colon adenocarcinoma, endometrial cancer, esophageal cancer, Ewing's sarcoma, gastric cancer, kidney clear cell cancer, lung cancer (e.g., lung adenocarcinoma or lung squamous cell cancer), mesothelioma, ovarian cancer, pancreatic cancer, peritoneal cancer, prostate cancer, uterine endometrial cancer, or uveal melanoma. In embodiments, a cancer is ovarian cancer, cancer of the fallopian tube(s), or peritoneal cancer. In embodiments, a cancer is breast cancer (e.g., TNBC). In embodiments, a cancer is lung cancer (e.g., non-small cell lung cancer). In embodiments, a cancer is prostate cancer.

In embodiments, a cancer is a CNS or brain cancer such as neuroblastoma (NB), glioma, diffuse intrinsic pontine glioma (DIPG), pilocytic astrocytoma, astrocytoma, anaplastic astrocytoma, glioblastoma multiforme, medulloblastoma, craniopharyngioma, ependymoma, pinealoma, hemangioblastoma, acoustic neuroma, oligodendroglioma, meningioma, vestibular schwannoma, adenoma, metastatic brain tumor, meningioma, spinal tumor, or medulloblastoma. In embodiments, a cancer is a CNS tumor.

In other embodiments, a cancer is melanoma, renal cell carcinoma, lung cancer, bladder cancer, breast cancer, cervical cancer, colon cancer, gall bladder cancer, laryngeal cancer, liver cancer, thyroid cancer, stomach cancer, salivary gland cancer, prostate cancer, pancreatic cancer, or Merkel cell carcinoma (see, e.g., Bhatia et al., Curr. Oncol. Rep., 13(6): 488-497 (2011)).

In some embodiments, a patient or population of patients have a hematological cancer. In some embodiments, the patient has a hematological cancer such as diffuse large B cell lymphoma ("DLBCL"), Hodgkin's lymphoma ("HL"), Non-Hodgkin's lymphoma ("NHL"), follicular lymphoma ("FL"), acute myeloid leukemia ("AML"), acute lymphoblastic leukemia ("ALL"), or multiple myeloma ("MM"). In embodiments, a cancer is a blood-borne cancer such as acute lymphoblastic leukemia ("ALL"), acute lymphoblastic B-cell leukemia, acute lymphoblastic T-cell leukemia, acute myeloblastic leukemia ("AML"), acute lymphoblastic leukemia ("ALL"), acute promyelocytic leukemia ("APL"), acute monoblastic leukemia, acute erythroleukemic leukemia, acute megakaryoblastic leukemia, acute myelomonocytic leukemia, acute nonlymphocyctic leukemia, acute undifferentiated leukemia, chronic myelocytic leukemia ("CML"), chronic lymphocytic leukemia ("CLL"), hairy cell leukemia and multiple myeloma; acute and chronic leukemias such as lymphoblastic, myelogenous, lymphocytic, and myelocytic leukemias. In embodiments, a hematological cancer is a lymphoma (e.g., Hodgkin's lymphoma (e.g., relapsed or refractory classic Hodgkin's Lymphoma (cHL), non-Hodgkin's lymphoma, diffuse large B-cell lymphoma, or precursor T-lymphoblastic lymphoma), lymphoepithelial carcinoma, or malignant histiocytosis.

In some embodiments, a patient or population of patients have a solid tumor. In embodiments, a cancer is a solid tumor such as fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, osteosarcoma, colon cancer, colorectal cancer, kidney cancer, pancreatic cancer, bone cancer, breast cancer, ovarian cancer, prostate cancer, esophageal cancer, stomach cancer, oral cancer, nasal cancer, throat cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilms tumor, cervical cancer, uterine cancer, testicular cancer, non small cell lung cancer (NSCLC), small cell lung carcinoma, bladder carcinoma, lung cancer, epithelial carcinoma, skin cancer, melanoma, neuroblastoma (NB), or retinoblastoma.

Therapeutic Agents

Certain aspects of the present disclosure relate to targeted therapies. In some embodiments, a targeted therapy includes one or more therapeutic agents, e.g., for treating a disease, disorder, or injury associated with an NTRK1, NTRK2, or NTRK3 fusion described herein. In some embodiments, the therapeutic agent, e.g., a second therapeutic agent, is an anti-cancer agent. In some embodiments, the anti-cancer agent is selected from a chemotherapeutic agent, an anti-hormonal agent, an antimetabolite chemotherapeutic agent, a kinase inhibitor, a methyltransferase inhibitor, a peptide, a gene therapy, a vaccine, a platinum-based chemotherapeutic agent, an immunotherapy, an antibody, and a checkpoint inhibitor.

Chemotherapeutic agents are chemical agent that inhibit the proliferation, growth, life-span and/or metastatic activity of cancer cells. Examples of chemotherapeutic agents include alkylating agents such as thiotepa and CYTOXAN® cyclosphosphamide; alkyl sulfonates such as busulfan, improsulfan and piposulfan; aziridines such as benzodopa, carboquone, meturedopa, and uredopa; ethylenimines and methylamelamines (e.g., altretamine, triethylenemelamine, trietylenephosphoramide, triethiylenethiophosphoramide and trimethylolomelamine); acetogenins; delta-9-tetrahydrocannabinol (e.g., dronabinol, MARINOL®); beta-lapachone; lapachol; colchicines; betulinic acid; a camptothecin (including the synthetic analogue topotecan (HYCAMTIN®), CPT-11 (irinotecan, CAMPTOSAR®), acetylcamptothecin, scopolectin, and 9-aminocamptothecin); bryostatin; callystatin; CC-1065 (including its adozelesin, carzelesin and bizelesin synthetic analogues); podophyllotoxin; podophyllinic acid; teniposide; cryptophycins (e.g., cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimnustine; antibiotics such as the enediyne antibiotics (e.g., calicheamicin); dynemicin, including dynemicin A; bisphosphonates, such as clodronate; an esperamicin; as well as neocarzinostatin chromophore and related chromoprotein enediyne antiobiotic chromophores), aclacinomysins, actinomycin, authramycin, azaserine, bleomycins, cactinomycin, carabicin, caminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (e.g., T-2 toxin, verracurin A, roridin A and anguidine); urethan; vindesine (ELDISINE®, FILDESIN®); dacarbazine; mannomustine; mitobronitol; mitolactol; pipobroman; gacytosine; arabinoside ("Ara-C"); cyclophosphamide; thiotepa; taxanes, e.g., TAXOL® paclitaxel (Bristol-Myers Squibb Oncology, Princeton, N.J.), ABRAXANE™ Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; gemcitabine (GEMZAR®); 6-thioguanine; mercaptopurine; methotrexate; platinum analogs such as cisplatin and carboplatin; vinblastine (VELBAN®); platinum; etoposide (VP-16); ifosfamide; mitoxantrone; vincristine (ONCOVIN*); oxaliplatin; leucovovin; vinorelbine (NAVELBINE®); novantrone; edatrexate; daunomycin; aminopterin; xeloda; ibandronate; topoisomerase inhibitor RFS 2000; difluoromethylornithine (DMFO); retinoids such as retinoic acid; capecitabine; pharmaceutically acceptable salts, acids or derivatives of any of the above; as well as combinations of two or more of the above such as CHOP, an abbreviation for a combined therapy of cyclophosphamide, doxorubicin, vincristine, and prednisone, and FOLFOX, an abbreviation for a treatment regimen with oxaliplatin (ELOXATIN™) combined with 5-FU and leucovovin.

Anti-hormonal agents are agents that act to regulate or inhibit hormone action on tumors such as anti-estrogens and selective estrogen receptor modulators (SERMs), including, for example, tamoxifen (including NOLVADEX® tamoxifen), raloxifene, droloxifene, 4-hydroxytamoxifen, trioxifene, keoxifene, LY117018, onapristone, and FARESTON® toremifene; aromatase inhibitors that inhibit the enzyme aromatase, which regulates estrogen production in the adrenal glands, such as, for example, 4(5)-imidazoles, aminoglutethimide, MEGACE® megestrol acetate, AROMASIN® exemestane, formestanie, fadrozole, RIVISOR® vorozole, FEMARA® letrozole, and ARIMIDEX® anastrozole; and anti-androgens such as flutamide, nilutamide, bicalutamide, leuprolide, and goserelin; as well as troxacitabine (a 1,3-dioxolane nucleoside cytosine analog); antisense oligonucleotides, particularly those that inhibit expression of genes in signaling pathways implicated in abherant cell proliferation, such as, for example, PKC-alpha, Raf, H-Ras, and epidermal growth factor receptor (EGF-R); vaccines such as gene therapy vaccines, for example, ALLOVECTIN® vaccine, LEUVECTIN® vaccine, and VAXID® vaccine; PROLEUKIN® rIL-2; LURTOTECAN® topoisomerase 1 inhibitor; ABARELIX® rmRH; and pharmaceutically acceptable salts, acids or derivatives of any of the above.

Antimetabolite chemotherapeutic agents are agents which are structurally similar to a metabolite, but cannot be used by the body in a productive manner. Many antimetabolite chemotherapeutic agents interfere with the production of the nucleic acids, RNA and DNA. Examples of antimetabolite chemotherapeutic agents include gemcitabine (GEMZAR®), 5-fluorouracil (5-FU), capecitabine (XELODA™), 6-mercaptopurine, methotrexate, 6-thioguanine, pemetrexed, raltitrexed, arabinosylcytosine ARA-C cytarabine (CYTOSAR-U®), dacarbazine (DTIC-DOMED), azocytosine, deoxycytosine, pyridmidene, fludarabine (FLUDARA®), cladrabine, 2-deoxy-D-glucose, etc. In some embodiments, an antimetabolite chemotherapeutic agent is gemcitabine. Gemcitabine HCl is sold by Eli Lilly under the trademark GEMZAR®.

Platinum-based chemotherapeutic agents are chemotherapeutic agents that comprise an organic compound which contains platinum as an integral part of the molecule. In some embodiments, a chemotherapeutic agent is a platinum agent. In some such embodiments, the platinum agent is selected from cisplatin, carboplatin, oxaliplatin, nedaplatin, triplatin tetranitrate, phenanthriplatin, picoplatin, or satraplatin.

As is known in the art, a checkpoint inhibitor targets at least one immune checkpoint protein to alter the regulation of an immune response, e.g., down-modulating or inhibiting an immune response. Immune checkpoint proteins include, e.g., CTLA4, PD-L1, PD-1, PD-L2, VISTA, B7-12, B7-H3, B7-H4, B7-H6, 2B4, ICOS, HVEM, CEACAM, LAIR1, CD80, CD86, CD276, VTCN1, MHC class I, MHC class II, GALS, adenosine, TGFR, CSF1R, MICA/B, arginase, CD160, gp49B, PIR-B, KIR family receptors, TIM-1, TIM-3, TIM-4, LAG-3, BTLA, SIRPalpha (CD47), CD48, 2B4 (CD244), B7.1, B7.2, ILT-2, ILT-4, TIGIT, LAG-3, BTLA, IDO, OX40, and A2aR. In some embodiments, a checkpoint inhibitor decreases the activity of a checkpoint protein that negatively regulates immune cell function, e.g., in order to enhance T cell activation and/or an anti-cancer immune response; in other embodiments, a checkpoint inhibitor increases the activity of a checkpoint protein that positively regulates immune cell function, e.g., in order to enhance T cell activation and/or an anti-cancer immune response. In some embodiments, the checkpoint inhibitor is an antibody. In some embodiments, the checkpoint inhibitor is an antibody. Examples of checkpoint inhibitors include, without limitation, a PD-L1 axis binding antagonist (e.g., an anti-PD-L1 antibody, e.g., atezolizumab (MPDL3280A)), an antagonist directed against a co-inhibitory molecule (e.g., a CTLA4 antagonist (e.g., an anti-CTLA4 antibody), a TIM-3 antagonist (e.g., an anti-TIM-3 antibody), or a LAG-3 antagonist (e.g., an anti-LAG-3 antibody)), or any combination thereof. In some embodiments, a cancer immunotherapy comprises a checkpoint inhibitor.

In some embodiments, the checkpoint inhibitor is a PD-L1 axis binding antagonist, e.g., a PD-1 binding antagonist, a PD-L1 binding antagonist, or a PD-L2 binding antagonist. PD-1 (programmed death 1) is also referred to in the art as "programmed cell death 1," "PDCD1," "CD279," and "SLEB2." An exemplary human PD-1 is shown in UniProtKB/Swiss-Prot Accession No. Q15116. PD-L1 (programmed death ligand 1) is also referred to in the art as "programmed cell death 1 ligand 1," "PDCD1 LG1," "CD274," "B7-H," and "PDL1." An exemplary human PD-L1 is shown in UniProtKB/Swiss-Prot Accession No. Q9NZQ7.1. PD-L2 (programmed death ligand 2) is also referred to in the art as "programmed cell death 1 ligand 2," "PDCD1 LG2," "CD273," "B7-DC," "Btdc," and "PDL2." An exemplary human PD-L2 is shown in UniProtKB/Swiss-Prot Accession No. Q9BQ51. In some instances, PD-1, PD-L1, and PD-L2 are human PD-1, PD-L1 and PD-L2.

In some instances, the PD-1 binding antagonist is a molecule that inhibits the binding of PD-1 to its ligand binding partners. In a specific aspect the PD-1 ligand binding partners are PD-L1 and/or PD-L2. In another instance, a PD-L1 binding antagonist is a molecule that inhibits the binding of PD-L1 to its binding ligands. In a specific aspect, PD-L1 binding partners are PD-1 and/or B7-1. In another instance, the PD-L2 binding antagonist is a molecule that inhibits the binding of PD-L2 to its ligand binding partners. In a specific aspect, the PD-L2 binding ligand partner is PD-1. The antagonist may be an antibody, an antigen binding fragment thereof, an immunoadhesin, a fusion protein, or oligopeptide. In some embodiments, the PD-1 binding antagonist is a small molecule, a nucleic acid, a polypeptide (e.g., antibody), carbohydrate, a lipid, a metal, or a toxin.

In some instances, the PD-1 binding antagonist is an anti-PD-1 antibody (e.g., a human antibody, a humanized antibody, or a chimeric antibody), for example, as described below. In some instances, the anti-PD-1 antibody is selected from the group consisting of MDX-1 106 (nivolumab), MK-3475 (pembrolizumab), MEDI-0680 (AMP-514), PDR001, REGN2810, MGA-012, JNJ-63723283, BI 754091, and BGB-108. MDX-1 106, also known as MDX-1 106-04, ONO-4538, BMS-936558, or nivolumab, is an anti-PD-1 antibody described in WO2006/121 168. MK-3475, also known as pembrolizumab or lambrolizumab, is an anti-PD-1 antibody described in WO 2009/1 14335. In some instances, the PD-1 binding antagonist is an immunoadhesin (e.g., an immunoadhesin comprising an extracellular or PD-1 binding portion of PD-L1 or PD-L2 fused to a constant region (e.g., an Fc region of an immunoglobulin sequence). In some instances, the PD-1 binding antagonist is AMP-224. AMP-224, also known as B7-DCIg, is a PD-L2-Fc fusion soluble receptor described in WO 2010/027827 and WO 2011/066342.

Other examples of anti-PD-1 antibodies include, but are not limited to, MEDI-0680 (AMP-514; AstraZeneca), PDR001 (CAS Registry No. 1859072-53-9; Novartis), REGN2810 (LIBTAYO® or cemiplimab-rwlc; Regeneron), BGB-108 (BeiGene), BGB-A317 (BeiGene), BI 754091, JS-001 (Shanghai Junshi), STI-A1110 (Sorrento), INCSHR-1210 (Incyte), PF-06801591 (Pfizer), TSR-042 (also known as ANB011; Tesaro/AnaptysBio), AM0001 (ARMO Biosciences), ENUM 244C8 (Enumeral Biomedical Holdings), ENUM 388D4 (Enumeral Biomedical Holdings). In some embodiments, the PD-1 binding antagonist is a peptide or small molecule compound. In some embodiments, the PD-1 binding antagonist is AUNP-12 (PierreFabre/Aurigene).

In some embodiments, the PD-L1 binding antagonist is a small molecule that inhibits PD-1. In some embodiments, the PD-L1 binding antagonist is a small molecule that inhibits PD-L1. In some embodiments, the PD-L1 binding antagonist is a small molecule that inhibits PD-L1 and VISTA or PD-L1 and TIM3. In some embodiments, the PD-L1 binding antagonist is CA-170 (also known as AUPM-170). In any of the instances herein, the isolated ant-PD-L1 antibody can bind to a human PD-L1, for example a human PD-L1 as shown in UniProtKB/Swiss-Prot Accession No. Q9NZQ7.1, or a variant thereof. In some embodiments, the PD-L1 binding antagonist is a small molecule, a nucleic acid, a polypeptide (e.g., antibody), carbohydrate, a lipid, a metal, or a toxin.

In some instances, the PD-L1 binding antagonist is an anti-PD-L1 antibody, for example, as described below. In some instances, the anti-PD-L1 antibody is capable of inhibiting binding between PD-L1 and PD-1 and/or between PD-L1 and B7-1. In some instances, the anti-PD-L1 antibody is a monoclonal antibody. In some instances, the anti-PD-L1 antibody is an antibody fragment selected from the group consisting of Fab, Fab'-SH, Fv, scFv, and (Fab')2 fragments. In some instances, the anti-PD-L1 antibody is a humanized antibody. In some instances, the anti-PD-L1 antibody is a human antibody. In some instances, the anti-PD-L1 antibody is selected from the group consisting of YW243.55.S70, MPDL3280A (atezolizumab), MDX-1 105, and MEDI4736 (durvalumab), and MSB0010718C (avelumab). Antibody YW243.55.S70 is an anti-PD-L1 described in WO 2010/077634. MDX-1 105, also known as BMS-936559, is an anti-PD-L1 antibody described in WO2007/005874. MED14736 (durvalurmab) is an anti-PD-LU monoclonal antibody described in WO2011/066389 and US2013/034559.

Other examples of anti-PD-L1 antibodies include, but are not limited to, MDX-1105 (BMS-936559; Bristol Myers Squibb), LY3300054 (Eli Lilly), STI-A1014 (Sorrento), KN035 (Suzhou Alphamab), FAZ053 (Novartis), or CX-072 (CytomX Therapeutics).

In some embodiments, the checkpoint inhibitor is CT-011, also known as hBAT, hBAT-1 or pidilizurnab, an antibody described in WO 2009/101611.

In some embodiments, the checkpoint inhibitor is an antagonist of CTL A4. In some embodiments, the checkpoint inhibitor is a small molecule antagonist of CTLA4. In some embodiments, the checkpoint inhibitor is an anti-CTLA4 antibody. CTLA4 is part of the CD28-B7 immunoglobulin superfamily of immune checkpoint molecules that acts to negatively regulate T cell activation, particularly CD28-dependent T cell responses. CTLA4 competes for binding to common ligands with CD28, such as CD80 (B7-1) and CD86 (B7-2), and binds to these ligands with higher affinity than CD28. Blocking CTLA4 activity (e.g., using an anti-CTLA4 antibody) is thought to enhance CD28-mediated costimulation (leading to increased T cell activation/priming), affect T cell development, and/or deplete Tregs (such as intratumoral Tregs). In some embodiments, the CTLA4 antagonist is a small molecule, a nucleic acid, a polypeptide (e.g., antibody), carbohydrate, a lipid, a metal, or a toxin.

In some embodiments, the anti-CTLA4 antibody is ipilimumab (YERVOY®; CAS Registry Number: 477202-00-9). Ipilimumab, also known as BMS-734016, MDX-010, and MDX-101, is a fully human monoclonal IgG1 kappa anti-CTLA4 antibody (Bristol-Myers Squibb) described in WO2001/14424. Other examples of anti-CTLA4 antibodies include, but are not limited to, APL-509, AGEN1884, and CS1002.

In some embodiments, a therapeutic agent, e.g., a second therapeutic agent, comprises a methyl transferase inhibitor such as EZM 2302 (EZM2302 or GSK 3359088), 3,5-bis [(3-bromo-4-hydroxyphenyl)methylene]-1-(phenylmethyl)-4-piperidinone), EPZ025654, or a suitable methyl transferase inhibitor known in the art.

In some embodiments, a targeted therapy or a treatment provided herein comprises selitrectinib in combination with crizotinib (see, e.g., Cocco et al., 2019; 31406350).

In some embodiments, a targeted therapy or a treatment provided herein comprises larotrectinib in combination with letrozole (see, e.g., Meric-Bernstam, et al., 2018; SABCS Abstract P6-20-02).

Kinase Inhibitors

Certain aspects of the present disclosure relate to targeted therapies. In some embodiments, a targeted therapy includes one or more NTRK inhibitors, such as larotrectinib and entrectinib. Such targeted therapies may benefit patients harboring NTRK fusions. These targeted therapies have shown high overall response rates (ORR) in current clinical trials (see, e.g., ClinicalTrials.gov numbers NCT02122913, NCT02637687, or NCT02576431). For example, larotrectinib showed a 75% ORR in NTRK fusion cancers.

The NTRK inhibitor, LOXO-195, was also shown to be safe, tolerable, and to have signs of clinical activity in solid tumor cancer patients with NTRK fusions that had become resistant to other TRK-targeted therapeutics (see, e.g., Hyman et al. CT127—Phase I and expanded access experience of LOXO-195 (BAY 2731954), a selective next-generation TRK inhibitor (TRKi). American Association for Cancer Research Annual Meeting 2019). For example, 10 patients of 29 evaluable patients (34%) had a confirmed complete or partial response as assessed by RECIST 1.1 criteria.

Several TRK family inhibitors, and kinase inhibitors that also inhibit NTRK1, are under clinical and preclinical investigation in solid tumors. The aurora kinase inhibitor danusertib (PHA-739358), in clinical trials in solid tumors, was shown to inhibit Ntrk1 as well as several other kinases (reviewed in Meulenbeld H J, Mathijssen R H, Verweij J, et al. (2012) *Expert Opin Investig Drugs* 21(3):383-93). A Phase 1 clinical trial of danusertib in 56 solid tumor patients reported an objective response in one non-small cell lung cancer patient and tumor regression in an ovarian cancer patient (Cohen R B, Jones S F, Aggarwal C, et al. (2009) *Clin Cancer Res* 15(21):6694-701). The selective Trk inhibitor lestaurtinib, which has been effective in clinical trials in neuroblastoma, was shown to inhibit tumor growth in preclinical xenograft models of neuroblastoma (Iyer R, Evans A E, Qi X, et al. (2010) *Clin Cancer Res* 16(5):1478-85). The selective Trk inhibitor AZ-23 was also shown to inhibit tumor growth in preclinical xenograft models of neuroblastoma (Thress K, Macintyre T, Wang H, et al. (2009) *Mol Cancer Ther* 8(7):1818-27). The dual Ntrk/cyclin-dependent kinase inhibitor PHA-848125 was shown to have anti-tumor effect in a variety of preclinical tumor xenograft models (Albanese C, Alzani R, Amboldi N, et al. (2010) *Mol Cancer Ther* 9(8):2243-54), and to inhibit tumor growth in a mouse model of lung adenocarcinoma with KRAS mutation (Degrassi A, Russo M, Nanni C, et al. (2010) *Mol Cancer Ther* 9(3):673-81). A Phase 1 clinical trial of PHA-848125 in solid tumors reported partial response in 2/14 patients and stable disease in 9/28 (Weiss G J, Hidalgo M, Borad M J, et al. (2011) Phase I study of the safety, tolerability and pharmacokinetics of PHA-848125AC, a dual tropomyosin receptor kinase A and cyclin-dependent kinase inhibitor, in patients with advanced solid malignancies. ePub December 2011). The Trk inhibitor CEP-2563 was shown to have anti-tumor activity in a variety of preclinical models, and a Phase 1 clinical trial of CEP-2563 demonstrated feasibility (Undevia S D, Vogelzang N J, Mauer A M, et al. (2004) *Invest New Drugs* 22(4):449-58). The Trk inhibitor K252a was shown in a lung adenocarcinoma cell line to block activation of the anti-apoptotic protein Akt, promote cell death, and reduce tumor cell growth (Perez-Pinera P, Hernandez T, Garcia-Suirez O, et al. (2007) *Mol Cell Biochem* 295(1-2):19-26). The multi-kinase inhibitor KRC-108 was shown to inhibit NTRK1 and to have antiproliferative activity in preclinical tumor models including a xenograft model of lung cancer (Han S Y, Lee C O, Ahn S H, et al. (2012) *Invest New Drugs* 30(2):518-23).

In one embodiment, the anti-cancer agent is a kinase inhibitor. For example, the kinase inhibitor is a multi-kinase inhibitor or a TrK- or NTRK-specific inhibitor. Exemplary multikinase inhibitors include, e.g., KRC-108, crizotinib, and K252a.

In one embodiment, the anti-cancer agent is a kinase inhibitor. Exemplary multikinase inhibitors include, e.g., KRC-108, crizotinib, and K252a. In another embodiment, the NTRK kinase inhibitor is chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486 (see e.g., Mok et al., 2016, CRI-CIMT-EATI-AACR Abstract A146, DOI: 10.1158/2326-6066.IMM2016-A146), a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a] pyrimidine, sitravatinib, SNA-125, tavilermide, thiazole 20h, ARRY-772, AZD7451, belizatinib, selitrectinib, crizotinib, ONO-7579 (see, e.g., clinical trial NCT03182257, available on the website https://clinicaltrials.gov/ct2/show/NCT03182257), merestinib (see, e.g., clinical trial NCT02920996, available at the website https://clinicaltrials.gov/ct2/show/NCT02920996), ensartinib (see, e.g., clinical trial NCT03574402, available at the website: https://clinicaltrials.gov/ct2/show/NCT03574402), TSR-011 (see, e.g., clinical trial NCT02048488, available at the website: https://clinicaltrials.gov/ct2/show/NCT02048488), MGCD516 (see, e.g., clinical trial NCT02219711, available at the website: https://clinicaltrials.gov/ct2/show/NCT02219711), altiratinib (see, e.g., clinical trial NCT02228811, available at the website: https://clinicaltrials.gov/ct2/show/NCT02228811), cabozantinib (see, e.g., clinical trial NCT01639508, available at the website: https://clinicaltrials.gov/ct2/show/NCT01639508), XL-184 (see, e.g., clinical trial NCT01639508, available at the website: https://clinicaltrials.gov/ct2/show/NCT01639508), DCC-2701 (see, e.g., clinical trial NCT02228811, available at the website: https://clinicaltrials.gov/ct2/show/NCT02228811), F17752 (see, e.g., Amatu et al., 2016; 27843590 and clinical trial EudraCT Number: 2013-003009-24), regorafenib (see, e.g., Khotskaya et al., 2017, 28174090, and the website: https://www.accessdata.fda.gov/drugsatfda_docs/label/2012/203085lbl.pdf), dovitinib (see, e.g., Sarker et al., 2008, 18381947), BMS-754807 (see, e.g., Carboni et al., 2009, 19996272), ENMD-2076 (see, e.g., Fletcher et al., 2011, 21177375), BMS-777607 (see, e.g., Schroeder et al., 2009, 19260711), midostaurin (see, e.g., Chi et al., 2012, 23131561; Okamura et al., 2018, 30637364), MK5108 (see, e.g., Shimomura et al., 2010, 20053775), PF-03814735 (see, e.g., Jani et al., 2010, 20354118), SNS-314 (see, e.g., Arbitrario et al., 2010, 19649632), nintedanib (see, e.g., Okamura et al., 2018; 30637364; Fuse et al., 2017; 28751539), ponatinib (see, e.g., Fuse et al., 2017; 28751539), foretinib (see, e.g., Nishiyama et al., 2018; 29463555), AZD 1480 (see, e.g., Gudernova et al., 2017; 29312610), or VMD-928. In another embodiment, the NTRK kinase inhibitor is chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo [1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928.

In one embodiment, the kinase inhibitor is entrectinib (also known as RXDX-101 or NMS-E628). Entrectinib is a selective tyrosine kinase inhibitor, with inhibitory activity against TrkA, TrkB, and TrkC; C-ros oncogene 1 (ROS1); and anaplastic lymphoma kinase (ALK). Entrectinib is administered orally. Entrectinib has the chemical name: N-[5-(3,5-Difluorobenzyl)-1H-indazol-3-yl]-4-(4-methyl-1-piperazinyl)-2-(tetrahydro-2H-pyran-4-ylamino)benzamide. Entrectinib has the following structure:

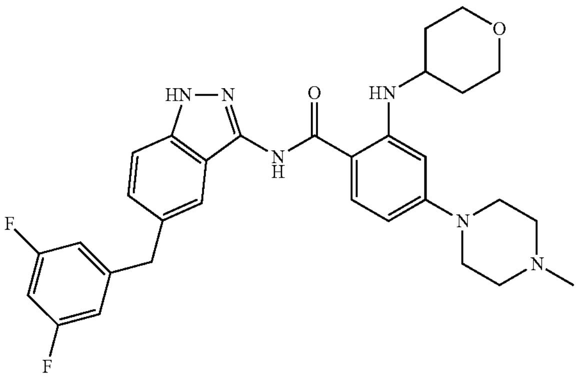 [SMILES: CN1CCN(c2ccc(C(=O)Nc3n[nH]c4ccc(Cc5cc(F)cc(F)c5)cc34)c(NC3CCOCC3)c2)CC1]

Entrectinib Chemical Structure

Molecular Weight: 560.64.

Clinical benefit with entrectinib monotherapy has been achieved for adult and pediatric patients with various solid tumors with and without CNS metastases and with NTRK fusions (Demetri et al., 2018; ESMO Abstract LBA17, Siena et al., 2019; ASCO Abstract 3017, Drilon et al., 2017; 28183697, Robinson et al., 2019; ASCO Abstract 10009, Doebele et al., 2019; ASCO Abstract 9070, Doebele et al., 2018; WCLC Abstract OA02.01), and preclinical sensitivity has been observed in NTRK fusion-positive AML cell lines (Smith et al., 2018; 29237803). In a Phase 1 trial, responses were restricted to patients harboring NTRK rearrangements (Drilon et al., 2017; 28183697).

Selitrectinib: In patients with NTRK fusion-positive cancers previously treated with at least 1 prior TRK inhibitor, treatment with selitrectinib achieved an ORR of 34% (10/29) with an ORR of 45% (9/20) in patients harboring a TRK kinase mutation (Hyman et al., 2019; AACR Abstract CT127).

In one embodiment, the kinase inhibitor is lestaurtinib (also known as CEP-701, rINN, KT 5555, SP 924). Lestaurtinib is an orally bioavailable indolocarbazole derivative with antineoplastic properties. Lestaurtinib is a tyrosine kinase inhibitor, with inhibitory activity against TrkA, TrkB, TrkC, FLT3, and JAK2. Lestaurtinib has the chemical name: (5S,6S,8R)-6-hydroxy-6-(hydroxymethyl)-5-methyl-7,8,14,15-tetrahydro-5H-16-oxa-4b,8a,14-triaza-5,8-methanodibenzo[b,h]cycloocta[jkl]cyclopenta[e]-as-indacen-13(6H)-one; and has the following structure:

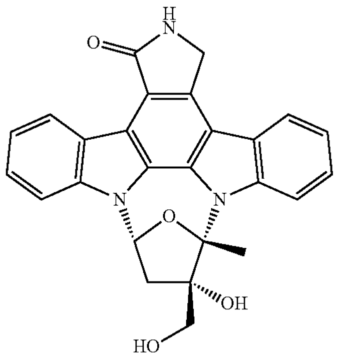 [SMILES: C[C@]12O[C@H](C[C@]1(O)CO)n1c3ccccc3c3c4c(c5c6ccccc6n2c5c31)CNC4=O]

Lestaurtinib Chemical Structure

Molecular Weight: 439.4626.

In another embodiment, the inhibitor is AZ-23. AZ-23 is selective tyrosine kinase Trk inhibitor with IC50 of 2 and 8 nM for TrkA and TrkB, respectively. AZ-23 has the chemical name: 5-chloro-N-[(1S)-1-(5-fluoropyridin-2-yl)ethyl]-N'-(5-propan-2-yloxy-1H-pyrazol-3-yl)pyrimidine-2,4-diamine; and the chemical structure:

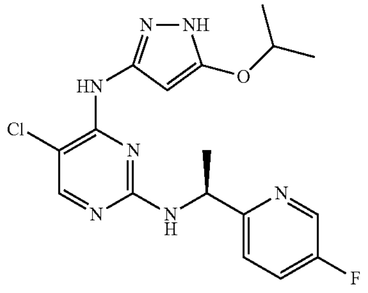 [SMILES: CC(C)Oc1cc(Nc2nc(N[C@@H](C)c3ccc(F)cn3)ncc2Cl)n[nH]1]

AZ-23 Chemical Structure

Molecular Weight: 391.83.

In another embodiment, the inhibitor is GW 441756. GW 441756 is a potent and orally active TrkA kinase inhibitor (IC50=2 nM) that displays more than 100-fold selectivity over a range of other kinases. GW 441756 has the chemical name: 3-[1-(1-Methyl-1H-indol-3-yl)-meth-(Z)-ylidene]-1,3-dihydro-pyrrolo[3,2-b]pyridin-2-one; and the chemical structure:

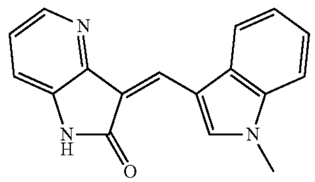 [SMILES: Cn1cc(/C=C2\C(=O)Nc3cccnc32)c2ccccc21]

GW 441756 Chemical Structure

Molecular Weight: 275.31.

In another embodiment, the inhibitor is isothiazole 5n. Isothiazole 5n is a TrkA kinase inhibitor with an IC50 of less than 1 nM. Isothiazole 5n has the chemical structure:

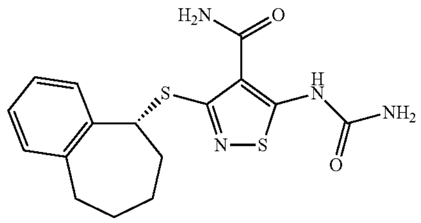 [SMILES: NC(=O)Nc1snc(S[C@@H]2CCCCc3ccccc32)c1C(N)=O]

Isothiazole 5n Chemical Structure

In another embodiment, the kinase inhibitor is indenopyrrolocarboazole 12a. Indenopyrrolocarboazole 12a is a TrkA kinase inhibitor with an IC50 of 8 nM. Indenopyrrolocarboazole 12a has the following structure:

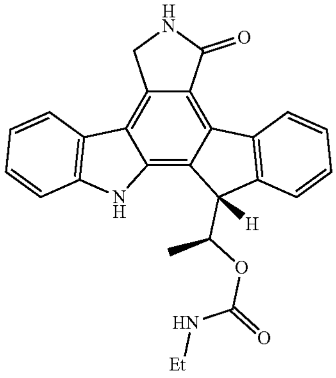 [SMILES: CCNC(=O)O[C@@H](C)[C@H]1c2ccccc2-c2c3c(c4c([nH]c5ccccc54)c21)CNC3=O]

Indenopyrrolocarboazole 12a Chemical Structure

In another embodiment, the kinase inhibitor is thiazole 20h. Thiazole 20h is a TrkA kinase inhibitor with an IC50 of 0.6 nM. Thiazole 20h has the following structure:

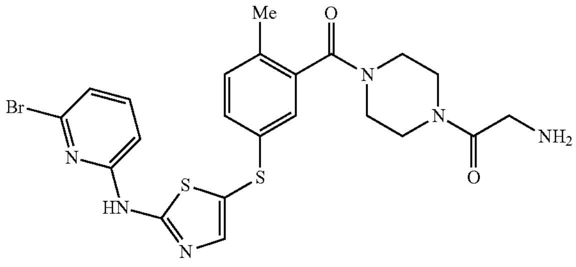 [SMILES: Cc1ccc(Sc2cnc(Nc3cccc(Br)n3)s2)cc1C(=O)N1CCN(C(=O)CN)CC1]

Thiazole 20h Chemical Structure

In another embodiment, the kinase inhibitor is oxindole 3. Oxindole 3 is a TrkA kinase inhibitor with an IC50 of 2 nM. Oxindole 3 has the following structure:

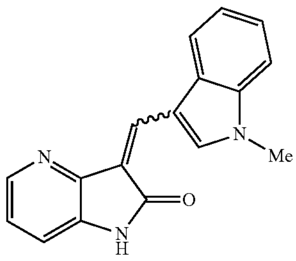 [SMILES: Cn1cc(C=C2C(=O)Nc3cccnc32)c2ccccc21]

Oxindole 3 Chemical Structure

In another embodiment, the kinase inhibitor is pyridocarbazole. Pyridocarbazole is a TrkA kinase inhibitor with an IC50 of 6 nM. Pyridocarbazole has the following structure:

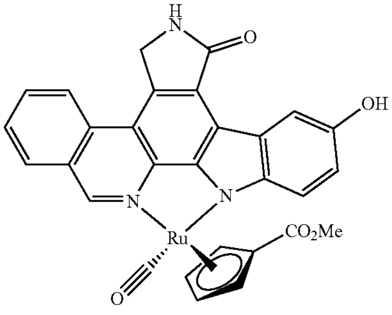

Pyridocarbazole Chemical Structure

In another embodiment, the kinase inhibitor is AR523. AR523 is a pan-Trk inhibitor which demonstrates similar activity against TrkA, TrkB and TrkC receptors.

In another embodiment, the kinase inhibitor is K252a. K252a is a Trk inhibitor which inhibits tyrosine phosphorylation of Trk A. K252a has the chemical name: (9S-(9a, 108,12a))-2,3,9,10,11,12-hexahydro-10-hydroxy-10-(methoxycarbonyl)-9-methyl-9,12-epoxy-1H-diindolo [1,2, 3-fg: 3',2',1'-kl] pyrrolo [3,4-i][1,6] benzodiazocin-1-one; and has the following structure:

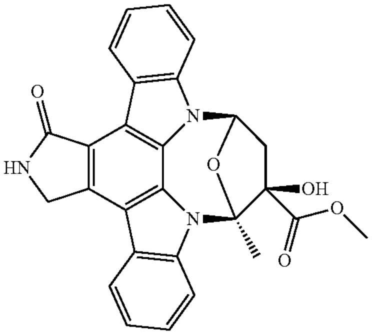 [SMILES: COC(=O)[C@@]1(O)C[C@H]2O[C@]1(C)n1c3ccccc3c3c4c(c5c6ccccc6n2c5c31)C(=O)NC4]

K252a Chemical Structure

Molecular Weight: 467.47274.

In another embodiment, the kinase inhibitor is GNF-5837. GNF-5837 is a potent pan-Trk inhibitor. GNF-5837 has the chemical name: N-[3-[[2,3-Dihydro-2-oxo-3-(1H-pyrrol-2-ylmethylene)-1H-indol-6-yl]amino]-4-methylphenyl]-N'-[2-fluoro-5-(trifluoromethyl)phenyl]urea; and has the following structure:

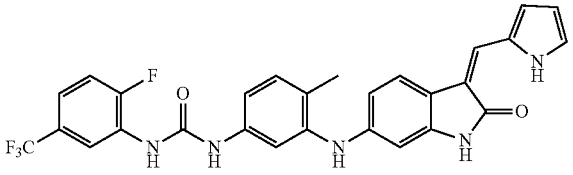 [SMILES: Cc1ccc(NC(=O)Nc2cc(C(F)(F)F)ccc2F)cc1Nc1ccc2c(c1)NC(=O)/C2=C\c1ccc[nH]1]

GNF-5837 Chemical Structure

Molecular Weight: 535.49.

In another embodiment, the kinase inhibitor is AG 879 (Tyrphostin AG 879). AG 879 is an inhibitor of the tyrosine kinase activity of nerve growth factor (NGF) TrkA. AG 879 has the chemical name (2E)-3-[3,5-Bis(1,1-dimethylethyl)-4-hydroxyphenyl]-2-cyano-2-propenethioamide; and has the following structure:

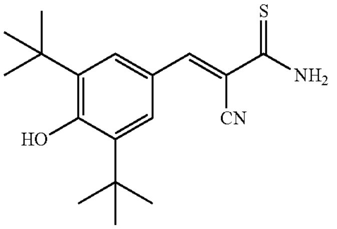 [SMILES: CC(C)(C)c1cc(/C=C(\C#N)C(N)=S)cc(C(C)(C)C)c1O]

AG 879 Chemical Structure

Molecular Weight: 316.46.

In another embodiment, the kinase inhibitor is Ro 08-2750. Ro 08-2750 is a non-peptide inhibitor of NGF that binds the NGF dimer ($K_D$~1 μM) possibly causing a conformational change. Ro 08-2750 has the following structure:

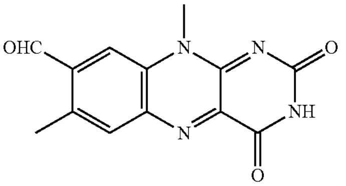 [SMILES: Cc1cc2nc3c(=O)[nH]c(=O)nc-3n(C)c2cc1C=O]

Ro 08-2750 Chemical Structure

Molecular Weight: 270.24.

In another embodiment, the kinase inhibitor is AZ623. AZ623 is a novel potent and selective inhibitor of the Trk family of tyrosine kinases.

In another embodiment, the kinase inhibitor is larotrectinib (previously known as LOXO-101 or ARRY-470). Larotrectinib is a pan-Trk inhibitor which demonstrates with an IC50 of 9.5, 24, and 24 against TrkA, TrkB and TrkC, respectively. Larotrectinib has the following chemical name and chemical structure:

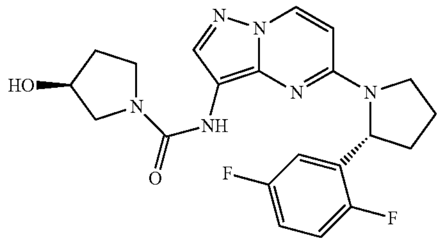 [SMILES: O=C(Nc1cnn2ccc(N3CCC[C@@H]3c3cc(F)ccc3F)nc12)N1CC[C@H](O)C1]

Larotrectinib

Molecular Weight: 428.444.

An analysis of combined data from a Phase 1, Phase 1/2, and Phase 2 trials reported an ORR of 81% (88/109) in adult and pediatric patients with various solid tumors, including soft tissue sarcoma, salivary gland tumor, thyroid carcinoma, GIST, lung tumor, melanoma, and CRC harboring NTRK fusions treated with larotrectinib; CR was observed in 17% of patients (Lassen et al., 2018; ESMO Abstract 4090). At 12 months of treatment, responses were ongoing in 75-81% of patients (Drilon et al., 2018; 29466156, Lassen et al., 2018; ESMO Abstract 4090). Acquired resistance to larotrectinib, putatively due to detected kinase domain mutations, was reported in 10 patients (Drilon et al., 2018; 29466156). The intracranial efficacy of larotrectinib has been demonstrated in several individuals with NTRK fusion-positive gliomas or brain metastases (Ziegler et al., 2018; 30220707, Schram et al., 2017; AACR abstract LB-302, Lassen et al., 2018; ESMO Abstract 4090).

In another embodiment, the kinase inhibitor is crizotinib. Durable clinical responses have also been reported in patients with NTRK1 fusion-positive tumors treated with the multikinase inhibitor crizotinib (Wong et al., 2015; 26563356, Mody et al., 2015; 26325560, Bender et al., 2019; 30709876, Vaishnavi et al., 2013; 24162815, Zhou et al., 2018; 30134855, Park et al., 2016; 26716414, Wang et al., 2019; 30691963).

In another embodiment, the kinase inhibitor is ARRY-772. ARRY-772 is a pan-Trk inhibitor which demonstrates with an IC50 of 10, 8.1, and 10 against TrkA, TrkB and TrkC, respectively.

In another embodiment, the kinase inhibitor is ARRY-772. ARRY-772 is a pan-Trk inhibitor which demonstrates with an IC50 of 2, 2.1, and 2.3 against TrkA, TrkB and TrkC, respectively.

In other embodiments, the anti-cancer agent is a fusion antagonist that inhibits the expression of nucleic acid encoding a fusion molecule described herein. Examples of such fusion antagonists include nucleic acid molecules, for example, antisense molecules, ribozymes, RNAi, triple helix molecules that hybridize to a nucleic acid encoding a fusion molecule described herein, or a transcription regulatory region, and block or reduce mRNA expression of a fusion molecule described herein.

Other approaches to Ntrk1 inhibition are also under investigation. Research has shown that HSP90 inhibitor 17-DMAG disrupted Ntrk1/Hsp90 binding, which results in degradation and depletion of Ntrk1, and reduced the growth of myeloid leukemia cells (Rao et al., 2010, supra). In one embodiment, the HSP90 inhibitor is a geldanamycin derivative, e.g., a benzoquinone or hygroquinone ansamycin HSP90 inhibitor. For example, the HSP90 inhibitor can be chosen from one or more of 17-AAG (also known as tanespimycin or CNF-1010; see, e.g., Fuse et al., (2017) Molecular Cancer Therapeutics, 16(10):2130-43), 17-DMAG, BIIB-021 (CNF-2024), BIIB-028, AUY-922 (also known as VER-49009), SNX-5422, STA-9090, AT-13387, XL-888, MPC-3100, CU-0305, CNF-1010, Macbecin I, Macbecin II, CCT-018159, CCT-129397, IPI-493, IPI-504, PU-H71, or PF-04928473 (SNX-2112).

In some embodiments, the targeted therapy comprises a peptide or polypeptide that inhibits expression and/or activity of a protein product of a fusion provided herein, e.g., an NTRK1, NTRK2, or NTRK3 fusion. For example, in some embodiments, the peptide or polypeptide binds to the protein product of a fusion provided herein, e.g., an NTRK1, NTRK2, or NTRK3 fusion. In some embodiments, the peptide or polypeptide binds to and inhibits one or more functions of the protein product of a fusion provided herein, e.g., an NTRK1, NTRK2, or NTRK3 fusion. In some embodiments, the targeted therapy comprises an antibody that inhibits expression and/or activity of a protein product of a fusion provided herein, e.g., an NTRK1, NTRK2, or NTRK3 fusion. For example, in some embodiments, the antibody binds to the protein product of a fusion provided herein, e.g., an NTRK1, NTRK2, or NTRK3 fusion, e.g., expressed on a cell surface. In some embodiments, the antibody binds to and inhibits one or more functions of the protein product of a fusion provided herein, e.g., an NTRK1, NTRK2, or NTRK3 fusion. In some embodiments, the antibody binds to and inhibits expression of the protein product of a fusion provided herein, e.g., an NTRK1, NTRK2, or NTRK3 fusion, e.g., cell-surface expression. In some embodiments, the antibody binds to the protein product of a fusion provided herein, e.g., an NTRK1, NTRK2, or NTRK3 fusion and induces cell death of a cell expressing the protein product, e.g., via antibody-dependent cellular cytotoxicity (ADCC), antibody-dependent cellular phagocytosis (ADCP), or cell death mediated by a toxin conjugated to the antibody (e.g., as with an antibody-drug conjugate, ADC). In some embodiments, the targeted therapy comprises a polypeptide that inhibits expression and/or activity of a protein product of a fusion provided herein, e.g., an NTRK1, NTRK2, or NTRK3 fusion. Exemplary antibodies of the present disclosure are described in greater detail herein.

In some embodiments, the targeted therapy comprises a targeted inhibitor, compound, or small molecule that inhibits expression and/or activity of a protein product of a fusion provided herein, e.g., an NTRK1, NTRK2, or NTRK3 fusion. In some embodiments, the targeted therapy comprises a compound or small molecule that inhibits one or more enzymatic activities (e.g., kinase activity, e.g., a TRKA, TRKB or TRKC kinase activity, of a protein product of a fusion provided herein, e.g., an NTRK1, NTRK2, or NTRK3 fusion, e.g., a competitive or non-competitive inhibitor. Exemplary compounds of the present disclosure, e.g., kinase inhibitors, are described in greater detail herein.

In some embodiments, a targeted therapy of the present disclosure comprises a nucleic acid that inhibits expression and/or activity of a protein product of a fusion provided herein, e.g., an NTRK1, NTRK2, or NTRK3 fusion. For example, in some embodiments, the targeted therapy comprises an antisense nucleic acid, ribozyme, siRNA, shRNA, miRNA, gRNA, or triple helix nucleic acid. In some embodiments, the nucleic acid may inhibit transcription, translation, and/or post-transcriptional stability of an mRNA molecule encoding the fusion provided herein, e.g., an NTRK1, NTRK2, or NTRK3 fusion, e.g., via an antisense oligonucleotide described herein. In some embodiments, the nucleic acid may inhibit expression of and/or direct the modification of DNA or RNA encoding the fusion provided herein, e.g., an NTRK1, NTRK2, or NTRK3 fusion, resulting in mutation or decreased/eliminated expression, e.g., via RNA editing or CRISPR-Cas9-mediated gene editing. In some embodiments, a targeted therapy inhibits expression of a fusion provided herein, e.g., an NTRK1, NTRK2, or NTRK3 fusion, by promoting G4 (G-quadruplex structure involving folded guanine tetrads) formation and/or stabilization in a promoter of a fusion provided herein, e.g., an NTRK1, NTRK2, or NTRK3 fusion, leading to downregulated transcription of the fusion.

In one embodiment, the targeted therapy, e.g., the kinase inhibitor (e.g., the multi-kinase inhibitor or the NTRK-specific inhibitor as described herein) is administered in combination with an HSP90 inhibitor, e.g., an HSP90 inhibitor as described herein.

In other embodiments, the targeted therapy, e.g., the kinase inhibitor is administered in combination with a second therapeutic agent or a different therapeutic modality, e.g., anti-cancer agents, and/or in combination with surgical and/or radiation procedures.

By "in combination with," it is not intended to imply that the therapy or the therapeutic agents must be administered at the same time and/or formulated for delivery together, although these methods of delivery are within the scope of the disclosure. The pharmaceutical compositions can be administered concurrently with, prior to, or subsequent to, one or more other additional therapies or therapeutic agents. In general, each agent will be administered at a dose and/or on a time schedule determined for that agent. In will further be appreciated that the additional therapeutic agent utilized in combination can be administered together in a single composition or administered separately in different compositions. The particular combination to employ in a regimen will take into account compatibility of the applicable pharmaceutical composition with the additional therapeutically active agent, therapeutic modality and/or the desired therapeutic effect to be achieved.

For example, the second therapeutic agent can be a cytotoxic or a cytostatic agent. Exemplary cytotoxic agents include antimicrotubule agents, topoisomerase inhibitors, taxanes, antimetabolites, mitotic inhibitors, alkylating agents, intercalating agents, agents capable of interfering with a signal transduction pathway, and agents that promote apoptosis and radiation. In yet other embodiments, the methods can be used in combination with immunodulatory agents, e.g., IL-1, 2, 4, 6, or 12, or interferon alpha or gamma, or immune cell growth factors such as GM-CSF.

Anti-cancer agents, e.g., kinase inhibitors, used in therapeutic methods can be evaluated using the screening assays described herein. In one embodiment, the anti-cancer agents are evaluated in a cell-free system, e.g., a cell lysate or in a reconstituted system. In other embodiments, the anti-cancer agents are evaluated in a cell in culture, e.g., a cell expressing fusion molecule described herein (e.g., a mammalian cell, a tumor cell or cell line, a recombinant cell). In yet other embodiments, the anti-cancer agents are evaluated in vivo (a fusion molecule-expressing cell present in a subject, e.g., an animal subject (e.g., an in vivo animal model)).

Exemplary parameters evaluated include one or more of: (i) a change in binding activity, e.g., direct binding of a candidate agent to a fusion polypeptide described herein; a binding competition between a known ligand and the candidate agent to a fusion polypeptide described herein; (ii) a change in kinase activity, e.g., phosphorylation levels of a fusion polypeptide described herein (e.g., an increased or decreased autophosphorylation of the fusion polypeptide); or a change in phosphorylation of a target of the kinase; (iii) a change in an activity of a cell containing a fusion molecule described herein (e.g., a tumor cell or a recombinant cell), e.g., a change in proliferation, morphology or tumorigenicity of the cell; (iv) a change in a tumor present in an animal subject, e.g., size, appearance, or proliferation, of the tumor; or (v) a change in the level, e.g., expression level, of a fusion polypeptide described herein or a nucleic acid molecule described herein.

In one embodiment, a change in a cell free assay in the presence of a candidate agent is evaluated. For example, an activity of a fusion molecule described herein, or interaction of a fusion molecule described herein with a downstream ligand can be detected.

In other embodiments, a change in an activity of a cell is detected in a cell in culture, e.g., a cell expressing a fusion molecule described herein (e.g., a mammalian cell, a tumor cell or cell line, a recombinant cell). In one embodiment, the cell is a recombinant cell that is modified to express a fusion nucleic acid described herein, e.g., is a recombinant cell transfected with a fusion nucleic acid described herein. The transfected cell can show a change in response to the expressed fusion molecule described herein, e.g., increased proliferation, changes in morphology, increased tumorigenicity, and/or acquired a transformed phenotype. A change in any of the activities of the cell, e.g., the recombinant cell, in the presence of the candidate agent can be detected. For example, a decrease in one or more of: proliferation, tumorigenicity, transformed morphology, in the presence of the candidate agent can be indicative of an inhibitor of a fusion molecule described herein. In other embodiments, a change in binding activity or phosphorylation as described herein is detected.

In yet other embodiments, a change in a tumor present in an animal subject (e.g., an in vivo animal model) is detected. In one embodiment, the animal model is a tumor containing animal or a xenograft comprising cells expressing a fusion molecule described herein (e.g., tumorigenic cells expressing a fusion molecule described herein). The anti-cancer agents can be administered to the animal subject and a change in the tumor is detected. In one embodiment, the change in the tumor includes one or more of a change in tumor growth, tumor size, tumor burden, or survival of the animal subject. A decrease in one or more of tumor growth, tumor size, tumor burden, or an increased survival may be indicative that the candidate agent is an inhibitor of a fusion molecule described herein.

The screening methods and assays are described in more detail herein below.

Screening Methods

In another aspect, the disclosure features a method, or assay, for screening for agents that modulate, e.g., inhibit, the expression or activity of a fusion molecule described herein. The method includes contacting a fusion molecule described herein, or a cell expressing a fusion molecule described herein, with a candidate agent; and detecting a change in a parameter associated with a fusion molecule described herein, e.g., a change in the expression or an activity of the fusion molecule described herein. The method can, optionally, include comparing the treated parameter to a reference value, e.g., a control sample (e.g., comparing a parameter obtained from a sample contacted with the candidate agent to a parameter obtained from a sample that has not been contacted with the candidate agent). In one embodiment, if a decrease in expression or activity of a fusion molecule described herein is detected, the candidate agent is identified as an inhibitor or a potential inhibitor of the fusion molecule. In another embodiment, if an increase in expression or activity of a fusion molecule described herein is detected, the candidate agent is identified as an activator. In certain embodiments, a fusion molecule described herein is a nucleic acid molecule or a polypeptide as described herein. In one embodiment, the contacting step is effected in a cell-free system, e.g., a cell lysate or in a reconstituted system. In other embodiments, the contacting step is effected in a cell in culture, e.g., a cell expressing a fusion molecule described herein (e.g., a mammalian cell, a tumor cell or cell line, a recombinant cell). In yet other embodiments, the contacting step is effected in a cell in vivo (a fusion molecule described herein-expressing cell present in a subject, e.g., an animal subject (e.g., an in vivo animal model)).

Exemplary parameters evaluated include one or more of: (i) a change in binding activity, e.g., direct binding of a candidate agent to a fusion polypeptide described herein; a binding competition between a known ligand and the candidate agent to a fusion polypeptide described herein; (ii) a change in kinase activity, e.g., phosphorylation levels of a fusion polypeptide described herein (e.g., an increased or decreased autophosphorylation of the fusion polypeptide); or a change in phosphorylation of a target of a kinase. In certain embodiments, a change in kinase activity, e.g., phosphorylation, is detected by any of Western blot (e.g., using an anti-MEX3A-NTRK1 fusion antibody or an anti-CARM1-NTRK3 fusion antibody, or an antibody that binds to a fusion polypeptide provided in Tables D, I, or N; a phosphor-specific antibody, detecting a shift in the molecular weight of a MEX3A-NTRK1 fusion polypeptide or a CARM1-NTRK3 fusion polypeptide or of a fusion polypeptide provided in Tables D, I, or N), mass spectrometry, immunoprecipitation, immunohistochemistry or immunomagnetic beads; (iii) a change in an activity of a cell containing a fusion molecule described herein (e.g., a tumor cell or a recombinant cell), e.g., a change in proliferation, morphology or tumorigenicity of the cell; (iv) a change in a tumor present in an animal subject, e.g., size, appearance, or proliferation, of the tumor; or (v) a change in the level, e.g., expression level, of a fusion polypeptide described herein or a nucleic acid molecule described herein.

In one embodiment, a change in a cell free assay in the presence of a candidate agent is evaluated. For example, an activity of a fusion molecule described herein, or interaction of a fusion molecule described herein with a downstream ligand can be detected. In one embodiment, a fusion polypeptide described herein is contacted with a ligand, e.g., in solution, and a candidate agent is monitored for an ability to modulate, e.g., inhibit, an interaction, e.g., binding, between the fusion polypeptide described herein and the ligand. In one exemplary assay, purified fusion protein described herein is contacted with a ligand, e.g., in solution, and a candidate agent is monitored for an ability to inhibit interaction of the fusion protein with the ligand, or to inhibit phosphorylation of the ligand by the fusion protein. An effect on an interaction between the fusion protein and the ligand can be monitored by methods known in the art, such as by absorbance, and an effect on phosphorylation of the ligand can be assayed, e.g., by Western blot, immunoprecipitation, or immunomagnetic beads.

In other embodiments, a change in an activity of a cell is detected in a cell in culture, e.g., a cell expressing a fusion molecule described herein (e.g., a mammalian cell, a tumor cell or cell line, a recombinant cell). In one embodiment, the cell is a recombinant cell that is modified to express a fusion nucleic acid described herein, e.g., is a recombinant cell transfected with a fusion nucleic acid described herein. The transfected cell can show a change in response to the expressed fusion molecule, e.g., increased proliferation, changes in morphology, increased tumorigenicity, and/or acquisition of a transformed phenotype. A change in any of the activities of the cell, e.g., the recombinant cell, in the presence of a candidate agent can be detected. For example, a decrease in one or more of: proliferation, tumorigenicity, transformed morphology, in the presence of the candidate agent can be indicative that the agent is an inhibitor of a fusion molecule described herein. In other embodiments, a change in binding activity or phosphorylation as described herein is detected.

In an exemplary cell-based assay, a nucleic acid comprising a fusion molecule described herein can be expressed in a cell, such as a cell (e.g., a mammalian cell) in culture. The cell containing a nucleic acid expressing the fusion molecule can be contacted with a candidate agent, and the cell can be monitored for an effect of the candidate agent. A candidate agent that causes decreased cell proliferation or cell death can be determined to be a candidate for treating a tumor (e.g., a cancer) that carries a fusion molecule described herein.

In one embodiment, a cell containing a nucleic acid expressing a fusion molecule described herein can be monitored for expression of the corresponding fusion protein. Protein expression can be monitored by methods known in the art, such as by, e.g., mass spectrometry (e.g., tandem mass spectrometry), a reporter assay (e.g., a fluorescence-based assay), Western blot, and immunohistochemistry. By one method, decreased fusion expression is detected. A candidate agent that causes decreased expression of the fusion protein can be determined to be a candidate for treating a tumor (e.g., a cancer) that carries a fusion molecule described herein. The cell containing a nucleic acid expressing a fusion molecule described herein may be compared to a cell that does not contain the fusion nucleic acid.

A cell containing a nucleic acid expressing a fusion molecule described herein can be monitored for altered kinase activity. Kinase activity can be assayed by measuring the effect of a candidate agent on a known kinase target protein.

In yet other embodiments, a change in a tumor present in an animal subject (e.g., an in vivo animal model) is detected. In one embodiment, the animal model is a tumor containing animal or a xenograft comprising cells expressing a fusion molecule described herein (e.g., tumorigenic cells expressing a fusion molecule described herein). The candidate agent can be administered to the animal subject and a change in the tumor is detected. In one embodiment, the change in the tumor includes a change in one or more of a tumor growth, tumor size, tumor burden, or survival. A decrease in one or more of tumor growth, tumor size, tumor burden, or an increased survival is indicative that the candidate agent is an inhibitor or a potential inhibitor of the fusion molecule.

In one exemplary animal model comprising a fusion described herein, a xenograft is created by injecting cells into a mouse. A candidate agent is administered to the mouse, e.g., by injection (such as subcutaneous, intraperitoneal, or tail vein injection, or by injection directly into the tumor) or oral delivery, and the tumor is observed to determine an effect, if any, of the candidate anti-cancer agent. The health of the animal is also monitored, such as to determine if an animal treated with the candidate agent survives longer. A candidate agent that causes growth of the tumor to slow or stop, or causes the tumor to shrink in size, or causes decreased tumor burden, or increases survival time, can be considered to be a candidate for treating a tumor (e.g., a cancer) that carries a fusion molecule described herein.

In another exemplary animal assay, cells expressing a fusion molecule described herein are injected into the tail vein, e.g., of a mouse, to induce metastasis. A candidate agent is administered to the mouse, e.g., by injection (such as subcutaneous, intraperitoneal, or tail vein injection, or by injection directly into the tumor) or oral delivery, and the tumor is observed to determine an effect, if any, of the candidate anti-cancer agent. A candidate agent that inhibits or prevents or reduces metastasis, or increases survival time, can be considered to be a candidate for treating a tumor (e.g., a cancer).

Cell proliferation can be measured by methods known in the art, such as a PCNA (Proliferating cell nuclear antigen) assay, 5-bromodeoxyuridine (BrdUrd) incorporation, a Ki-67 assay, mitochondrial respiration, or propidium iodide staining. Cells can also be measured for apoptosis, such as by use of a TUNEL (Terminal Deoxynucleotide Transferase dUTP Nick End Labeling) assay. Cells can also be assayed for the presence of angiogenesis using methods known in the art, such as by measuring endothelial tube formation or by measuring the growth of blood vessels from subcutaneous tissue, such as into a solid gel of basement membrane.

In other embodiments, a change in expression of a fusion molecule described herein can be monitored by detecting the nucleic acid or protein levels, e.g., using the methods described herein.

In certain embodiments, the screening methods described herein can be repeated and/or combined. In one embodiment, a candidate agent that is evaluated in a cell-free or cell-based assay described herein can be further tested in an animal subject.

In one embodiment, the candidate agent is identified and re-tested in the same or a different assay. For example, a test compound is identified in an in vitro or cell-free system and re-tested in an animal model or a cell-based assay. Any order or combination of assays can be used. For example, a high throughput assay can be used in combination with an animal model or tissue culture.

Candidate agents suitable for use in the screening assays described herein include, e.g., small molecule compounds, nucleic acids (e.g., siRNAs, aptamers, short hairpin RNAs (shRNAs), antisense oligonucleotides, ribozymes, antagomirs, microRNA mimics, or guide RNAs (gRNAs) or polypeptides, e.g., antibodies (e.g., full length antibodies or antigen-binding fragments thereof, Fab fragments, or scFv fragments). The candidate anti-cancer agents can be obtained from a library (e.g., a commercial library), or can be rationally designed, such as to target an active site in a functional domain (e.g., a kinase domain).

In other embodiments, the method, or assay, includes providing a step based on proximity-dependent signal generation, e.g., a two-hybrid assay that includes a first fusion protein (e.g., a fusion protein described herein), and a second fusion protein (e.g., a ligand), contacting the two-hybrid assay with a test agent, under conditions wherein said two hybrid assay detects a change in the formation and/or stability of a complex, e.g., the formation of a complex of a DNA-binding domain and activating domain initiates transcriptional activation of a reporter gene.

In one non-limiting example, the three-dimensional structure of the active site of a fusion molecule described herein is determined by crystallizing the complex formed by the fusion molecule and a known inhibitor. Rational drug design is then used to identify new test agents by making alterations in the structure of a known inhibitor or by designing small molecule compounds that bind to the active site of the fusion.

The candidate agents can be obtained using any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann, R. N. et al. (1994) *J. Med. Chem.* 37:2678-85; spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam (1997) *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and Gallop et al. (1994) *J Med. Chem.* 37:1233.

Libraries of compounds may be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner, U.S. Pat. No. 5,223,409), spores (Ladner U.S. Pat. No. 5,223,409), plasmids (Cull et al. (1992) *Proc Natl Acad Sci USA* 89:1865-1869) or on phage (Scott and Smith (1990) *Science* 249:386-390; Devlin (1990) *Science* 249:404-406; Cwirla et al. (1990) *Proc. Natl. Acad. Sci.* 87:6378-6382; Felici (1991) *J Mol. Biol.* 222:301-310; and Ladner supra.).

The interaction between two molecules can also be detected, e.g., using fluorescence energy transfer (FET) (see, for example, Lakowicz et al., U.S. Pat. No. 5,631,169; Stavrianopoulos, et al., U.S. Pat. No. 4,868,103). A fluorophore label on the first, 'donor' molecule is selected such that its emitted fluorescent energy will be absorbed by a fluorescent label on a second, 'acceptor' molecule, which in turn is able to fluoresce due to the absorbed energy. Alternately, the 'donor' protein molecule may simply utilize the natural fluorescent energy of tryptophan residues. Labels are chosen that emit different wavelengths of light, such that the 'acceptor' molecule label may be differentiated from that of the 'donor'. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. An FET binding event can be conveniently measured through standard fluorometric detection means known in the art (e.g., using a fluorimeter).

In another embodiment, determining the ability of a fusion protein to bind to a target molecule can be accomplished using real-time Biomolecular Interaction Analysis (BIA) (see, e.g., Sjolander, S. and Urbaniczky, C. (1991) *Anal. Chem.* 63:2338-2345 and Szabo et al. (1995) *Curr. Opin. Struct. Biol.* 5:699-705). "Surface plasmon resonance" or "BIA" detects biospecific interactions in real time, without labeling any of the interactants (e.g., BIAcore).

Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

Nucleic Acid Inhibitors

The expression and function of a fusion nucleic acid molecule encoding a fusion polypeptide described herein can be inhibited by an inhibitor described herein. Examples of such fusion inhibitors include nucleic acid molecules, for example, antisense molecules, dsRNAs, siRNAs, shRNAs, ribozymes, gRNAs, or triple helix molecules, which hybridize to a nucleic acid encoding a fusion molecule described herein, or a transcription regulatory region, and block or reduce mRNA expression of the fusion. Accordingly, nucleic acid molecules that are nucleic acid inhibitors, e.g., antisense molecules, siRNAs, shRNAs, ribozymes, gRNAs, or triple helix molecules to a fusion polypeptide-encoding nucleic acid molecule are provided.

Antisense Molecules

In some embodiments, the nucleic acid inhibitor is an antisense nucleic acid molecule. An "antisense" nucleic acid can include a nucleotide sequence which is complementary to a "sense" nucleic acid encoding a protein, e.g., complementary to the coding strand of a double-stranded cDNA molecule or complementary to an mRNA sequence. The antisense nucleic acid can be complementary to an entire fusion coding strand, or to only a portion thereof. In another embodiment, the antisense nucleic acid molecule is antisense to a "noncoding region" of the coding strand of a nucleotide sequence encoding fusion (e.g., the 5' and 3' untranslated regions). Anti-sense agents can include, for example, from about 8 to about 80 nucleobases (i.e., from about 8 to about 80 nucleotides), e.g., about 8 to about 50 nucleobases, or about 12 to about 30 nucleobases. Antisense compounds include ribozymes, external guide sequence (EGS) oligonucleotides (oligozymes), and other short catalytic RNAs or catalytic oligonucleotides which hybridize to the target nucleic acid and modulate its expression. Antisense compounds can include a stretch of at least eight consecutive nucleobases that are complementary to a sequence in the target gene. An oligonucleotide need not be 100% complementary to its target nucleotide sequence to be specifically hybridizable. An oligonucleotide is specifically hybridizable when binding of the oligonucleotide to the target interferes with the normal function of the target molecule to cause a loss of utility, and there is a sufficient degree of complementarity to avoid non-specific binding of the oligonucleotide to non-target sequences under conditions in which specific binding is desired, i.e., under physiological conditions in the case of in vivo assays or therapeutic treatment or, in the case of in vitro assays, under conditions in which the assays are conducted.

Hybridization of antisense oligonucleotides with mRNA can interfere with one or more of the normal functions of mRNA. The functions of mRNA to be interfered with include all key functions such as, for example, translocation of the RNA to the site of protein translation, translation of protein from the RNA, splicing of the RNA to yield one or more mRNA species, and any catalytic activity which may be engaged in by the RNA. Binding of specific protein(s) to the RNA may also be interfered with by antisense oligonucleotide hybridization to the RNA.

Exemplary antisense compounds include DNA or RNA sequences that specifically hybridize to the target nucleic acid, e.g., the mRNA encoding a fusion molecule described herein. The complementary region can extend for between about 8 to about 80 nucleobases. The compounds can include one or more modified nucleobases. Modified nucleobases may include, e.g., 5-substituted pyrimidines such as 5-iodouracil, 5-iodocytosine, and C5-propynyl pyrimidines such as C5-propynylcytosine and C5-propynyluracil. Other suitable modified nucleobases include $N^4$—($C_1$-$C_{12}$) alkylaminocytosines and $N^4$,$N^4$—($C_1$-$C_{12}$) dialkylaminocytosines. Modified nucleobases may also include 7-substituted-8-aza-7-deazapurines and 7-substituted-7-deazapurines such as, for example, 7-iodo-7-deazapurines, 7-cyano-7-deazapurines, 7-aminocarbonyl-7-deazapurines. Examples of these include 6-amino-7-iodo-7-deazapurines, 6-amino-7-cyano-7-deazapurines, 6-amino-7-aminocarbonyl-7-deazapurines, 2-amino-6-hydroxy-7-iodo-7-deazapurines, 2-amino-6-hydroxy-7-cyano-7-deazapurines, and 2-amino-6-hydroxy-7-aminocarbonyl-7-deazapurines. Furthermore, $N^6$—($C_1$-$C_{12}$) alkylaminopurines and $N^6$,$N^6$—($C_1$-$C_{12}$) dialkylaminopurines, including $N^6$-methylaminoadenine and $N^6$,$N^6$-dimethylaminoadenine, are also suitable modified nucleobases. Similarly, other 6-substituted purines including, for example, 6-thioguanine may constitute appropriate modified nucleobases. Other suitable nucleobases include 2-thiouracil, 8-bromoadenine, 8-bromoguanine, 2-fluoroadenine, and 2-fluoroguanine. Derivatives of any of the aforementioned modified nucleobases are also appropriate. Substituents of any of the preceding compounds may include $C_1$-$C_{30}$ alkyl, $C_2$-$C_{30}$ alkenyl, $C_2$-$C_{30}$ alkynyl, aryl, aralkyl, heteroaryl, halo, amino, amido, nitro, thio, sulfonyl, carboxyl, alkoxy, alkylcarbonyl, alkoxycarbonyl, and the like. Descriptions of other types of nucleic acid agents are also available. See, e.g., U.S. Pat. Nos. 4,987,071; 5,116,742; and 5,093,246; Woolf et al. (1992) *Proc Natl Acad Sci USA; Antisense RNA and DNA*, D. A. Melton, Ed., Cold Spring Harbor Laboratory, Cold Spring Harbor, N.Y. (1988); 89:7305-9; Haselhoff and Gerlach (1988) *Nature* 334:585-59; Helene, C. (1991) *Anticancer Drug Des.* 6:569-84; Helene (1992) *Ann. N.Y. Acad. Sci.* 660:27-36; and Maher (1992) *Bioassays* 14:807-15.

In yet another embodiment, the antisense nucleic acid molecule is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The antisense nucleic acid molecules are typically administered to a subject (e.g., by direct injection at a tissue site), such that they hybridize with or bind to cellular mRNA and/or genomic DNA encoding a fusion molecule described herein to thereby inhibit expression of the protein, e.g., by inhibiting transcription and/or translation. Alternatively, antisense nucleic acid molecules can be modified to target selected cells and then be administered systemically. For systemic administration, antisense molecules can be modified such that they specifically bind to receptors or antigens expressed on a selected cell surface, e.g., by linking the antisense nucleic acid molecules to peptides or antibodies which bind to cell surface receptors or antigens. In some embodiments, an antisense nucleic acid is formulated in a delivery vehicle. The antisense nucleic acid molecules can also be delivered to cells using the vectors described herein. To achieve sufficient intracellular concentrations of the antisense molecules, vector constructs in which the antisense nucleic acid molecule is placed under the control of a strong RNA polymerase II or RNA polymerase III promoter can be used.

Ribozyme

In another embodiment, the nucleic acid inhibitor featured in the disclosure is a ribozyme. A ribozyme having specificity for a fusion-encoding nucleic acid can include one or more sequences complementary to the nucleotide sequence of a fusion cDNA disclosed herein, and a sequence having known catalytic sequence responsible for mRNA cleavage (see U.S. Pat. No. 5,093,246 or Haselhoff and Gerlach (1988) *Nature* 334:585-591). For example, a derivative of a Tetrahymena L-19 IVS RNA can be constructed in which the nucleotide sequence of the active site is complementary to the nucleotide sequence to be cleaved in a fusion-encoding mRNA. See, e.g., Cech et al. U.S. Pat. No. 4,987,071; and Cech et al. U.S. Pat. No. 5,116,742. Alternatively, fusion mRNA can be used to select a catalytic RNA having a specific ribonuclease activity from a pool of RNA molecules. See, e.g., Bartel, D. and Szostak, J. W. (1993) *Science* 261:1411-1418.

Triple Helix Molecules

Inhibition of a fusion nucleic acid molecule described herein can be accomplished by targeting nucleotide sequences complementary to the regulatory region of the fusion to form triple helical structures that prevent transcription of the fusion gene in target cells. See generally, Helene, C. (1991) *Anticancer Drug Des.* 6:569-84; Helene, C. i (1992) *Ann. N.Y. Acad. Sci.* 660:27-36; and Maher, L. J. (1992) *Bioassays* 14:807-15. The potential sequences that can be targeted for triple helix formation can be increased by creating a so-called "switchback" nucleic acid molecule. Switchback molecules are synthesized in an alternating 5'-3', 3'-5' manner, such that they base pair with first one strand of a duplex and then the other, eliminating the necessity for a sizeable stretch of either purines or pyrimidines to be present on one strand of a duplex.

Double-Stranded RNAs (DsRNAs)

In some embodiments, the nucleic acid inhibitor is a dsRNA molecule. dsRNAs having a duplex structure of between about 20 and 23 base pairs, e.g., 21, base pairs are effective at inducing RNA interference (RNAi) (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226).

In one embodiment, the dsRNA, is unmodified, and does not comprise, e.g., chemical modifications and/or conjugations known in the art or described herein. In another embodiment, the dsRNA, is chemically modified to enhance stability or other beneficial characteristics. The dsRNA can be synthesized and/or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. While a target sequence of a dsRNA can be generally about 15-30 nucleotides, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art) to identify those sequences that perform optimally can identify those RNA sequences that, when targeted with a dsRNA molecule, mediate the best inhibition of target gene expression. Thus, while the sequences identified herein represent effective target sequences, it is contemplated that further optimization of inhibition efficiency can be achieved by progressively "walking the window" one nucleotide upstream or downstream of the given sequences to identify sequences with equal or better inhibition characteristics.

In some embodiments, the nucleic acid inhibitor is a small interfering ribonucleic acid (siRNA) molecule. siRNAs are small double stranded RNAs (dsRNAs) that optionally include overhangs. For example, the duplex region of an siRNA is about 18 to 25 nucleotides, e.g., about 19, 20, 21, 22, 23, or 24 nucleotides. Typically, the siRNA sequences are exactly complementary to the target mRNA. dsRNAs and siRNAs in particular can be used to silence gene expression in mammalian cells (e.g., human cells). siRNAs also include short hairpin RNAs (shRNAs) with 29-base-pair stems and 2-nucleotide 3' overhangs. See, e.g., Clemens et al. (2000) *Proc. Natl. Acad. Sci. USA* 97:6499-6503; Billy et al. (2001) *Proc. Natl. Sci. USA* 98:14428-14433; Elbashir et al. (2001) *Nature.* 411:494-8; Yang et al. (2002) *Proc. Natl. Acad. Sci. USA* 99:9942-9947; Siolas et al. (2005), *Nat. Biotechnol.* 23(2):227-31; U.S. Patent Publication No. 20040086884; U.S. Patent Publication No. 20030166282; U.S. Patent Publication No. 20030143204; U.S. Patent Publication No. 20040038278; and U.S. Patent Publication No. 20030224432.

Modifications of Nucleic Acid Inhibitors

A nucleic acid inhibitor can be modified to enhance or obtain beneficial characteristics. For example, a nucleic acid inhibitor can be modified at the base moiety, sugar moiety or phosphate backbone to improve, e.g., the stability, hybridization, or solubility of the molecule. For non-limiting examples of synthetic oligonucleotides with modifications see Toulmé (2001) *Nature Biotech.* 19:17 and Faria et al. (2001) *Nature Biotech.* 19:40-44. Such phosphoramidite oligonucleotides can be effective antisense agents.

A nucleic acid inhibitor molecule can be modified to include one or more bridged nucleic acids (BNAs). A bridged nucleic acid is a nucleotide bearing a conformationally restricted sugar moiety. Oligonucleotides containing BNAs show high binding affinity with RNA complementary strands, and are more tolerant to endonucleolytic and exonucleolytic degradation (Roongjang, S. et al. (2007) *Nucleic Acids Symp Ser* (Oxf) 51:113-114). Exemplary BNAs include, e.g., 2'4'-BNA (also known as LNA (see below); 3'-amino2',4'-BNA, 3',4'-BNA; $BNA^{COC}$; $BNA^{NC}$, and $BNA^{ME}$. The structure of the BNA will influence the binding affinity of the nucleic acid molecule with complementary single stranded DNA and double stranded DNA, as well as its enzymatic stability against nuclease degradation. The synthesis and purification of BNA molecules can be performed using standard protocols, (e.g., see Imanishi T, et al. (2002) *Chem. Commun.* 16: 1653-1659).

In some embodiments, the nucleic acid can be modified to generate peptide nucleic acids (see Hyrup B. et al. (1996) *Bioorganic & Medicinal Chemistry* 4: 5-23). As used herein, the terms "peptide nucleic acid" or "PNA" refers to a nucleic acid mimic, e.g., a DNA or RNA mimic, in which the deoxyribose or ribose phosphate backbone is replaced by a pseudopeptide backbone and only the four natural nucleobases are retained. The neutral backbone of a PNA can allow for specific hybridization to DNA and RNA under conditions of low ionic strength. PNAs of nucleic acid inhibitor molecules can be used in therapeutic and diagnostic applications. For example, PNAs can be used as antisense, antigene, siRNA, or RNAi agents for sequence-specific modulation of gene expression by, for example, inducing transcription or translation arrest or inhibiting replication. PNAs of nucleic acid inhibitor molecules can also be used in the analysis of single base pair mutations in a gene, (e.g., by PNA-directed PCR clamping); as 'artificial restriction enzymes' when used in combination with other enzymes, (e.g., S1 nucleases (Hyrup B. et al. (1996) supra)); or as probes or primers for DNA sequencing or hybridization (Hyrup B. et al. (1996) supra; Perry-O'Keefe supra).

The synthesis of PNA oligomers can be performed using standard solid phase peptide synthesis protocols as described in Hyrup B. et al. (1996) supra and Perry-O'Keefe et al. *Proc. Natl. Acad. Sci.* 93: 14670-675. Representative U.S. patents that teach the preparation of PNA compounds include, e.g., U.S. Pat. Nos. 5,539,082; 5,714,331; and 5,719,262, the entire contents of each of which are hereby incorporated herein by reference. Additional PNA compounds suitable for use in RNA molecules are described in, for example, in Nielsen et al., *Science,* 1991, 254, 1497-1500.

The nucleic acid inhibitor molecules can also be modified to include one or more locked nucleic acids (LNA). A locked nucleic acid is a nucleotide having a modified sugar moiety in which the sugar moiety comprises an extra bridge connecting the 2' and 4' carbons. This structure effectively "locks" the ribose in the 3'-endo structural conformation. LNA containing nucleic acid molecules possess high affinity to complementary DNA and RNA and improved mismatch discrimination relative to unmodified nucleic acid molecules (Jepson, J., et al. (2004) *Oligonucleotides* 14:130-146). The addition of locked nucleic acids to siRNAs has been shown to increase siRNA stability in serum, and to reduce off-target effects (Elmen, J. et al. (2005) *Nucleic Acids Research* 33(1):439-447; Mook, O R. et al. (2007) *Mol Canc Ther* 6(3):833-843; Grunweller, A. et al. (2003) *Nucleic Acids Research* 31(12):3185-3193). Representative U.S. patents that teach the preparation of locked nucleic acid nucleotides include, e.g., the following: U.S. Pat. Nos. 6,268,490; 6,670,461; 6,794,499; 6,998,484; 7,053,207; 7,084,125; and 7,399,845, the entire contents of each of which are hereby incorporated herein by reference.

A nucleic acid inhibitor molecule can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, those disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the disclosure. These include 5-substituted pyrimidines, 6-azapyrimidines and N-2, N-6 and O-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, e.g., the above noted U.S. Pat. Nos. 3,687,808, 4,845,205; 5,130,30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

Potentially stabilizing modifications to the ends of nucleic acid inhibitor molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found, for example, in PCT Publication No. WO 2011/005861.

In other embodiments, the nucleic acid inhibitor molecule may include other appended groups such as peptides (e.g., for targeting host cell receptors in vivo), or agents facilitating transport across the cell membrane (see, e.g., Letsinger et al. (1989) *Proc. Natl. Acad. Sci. USA* 86:6553-6556; Lemaitre et al. (1987) *Proc. Natl. Acad. Sci. USA* 84:648-652; PCT Publication No. WO 88/09810) or the blood-brain barrier (see, e.g., PCT Publication No. WO 89/10134). In addition, oligonucleotides can be modified with hybridization-triggered cleavage agents (see, e.g., Krol et al. (1988) *Bio-Techniques* 6:958-976) or intercalating agents (See, e.g., Zon (1988) *Pharm. Res.* 5:539-549). To this end, the oligonucleotide may be conjugated to another molecule, (e.g., a peptide, hybridization triggered cross-linking agent, transport agent, or hybridization-triggered cleavage agent).

In some embodiments, modifications to the fusion nucleic acid molecules can include, for example, end modifications, e.g., 5'-end modifications (phosphorylation, conjugation, or inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; and/or backbone modifications, including modification or replacement of the phosphodiester linkages. Specific examples include, e.g. fusion nucleic acid molecules containing modified backbones or no natural internucleoside linkages. Fusion nucleic acid molecules having modified backbones include, among others, those that do not have a phosphorus atom in the backbone.

Modified nucleic acid backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative U.S. patents that teach the preparation of the above phosphorus-containing linkages include, e.g., U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; and 7,321,029; and U.S. Pat. No. RE39,464, the entire contents of each of which are hereby incorporated herein by reference.

Modified nucleic acid backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts.

Representative U.S. patents that teach the preparation of the above oligonucleosides include, e.g., U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and, 5,677, 439, the entire contents of each of which are hereby incorporated herein by reference.

Some embodiments include nucleic acid inhibitor molecules with phosphorothioate backbones and oligonucleosides with heteroatom backbones, and in particular $—CH_2—NH—CH_2—$, $—CH_2—N(CH_3)—O—CH_2$-[known as a methylene (methylimino) or MMI backbone], $—CH_2—O—N(CH_3)—CH_2—$, $—CH_2—N(CH_3)—N(CH_3)—CH_2—$ and $—N(CH_3)—CH_2$-[wherein the native phosphodiester backbone is represented as $—O—P—O—CH_2—$] of U.S. Pat. No. 5,489,677, and the amide backbones of U.S. Pat. No. 5,602,240.

Modified nucleic acid inhibitor molecules can also contain one or more substituted sugar moieties. The nucleic acid, e.g., RNA, molecules can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an RNA molecule, or a group for improving the pharmacodynamic properties of an RNA molecule, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta,* 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_2)_2$.

Other modifications can include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an RNA molecule, particularly the 3' position of the sugar on the 3' terminal nucleotide or in 2'-5' linked dsRNAs and the 5' position of 5' terminal nucleotide. RNA molecules can also have sugar mimetics such as cyclobutyl moieties in place of the pentofuranosyl sugar. Representative U.S. patents that teach the preparation of such modified sugar structures include, e.g., U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920. The entire contents of each of the foregoing are hereby incorporated herein by reference.

In some embodiments, a targeted therapy (e.g., a kinase inhibitor) of the present disclosure is administered in combination with another therapy, such as a second therapeutic agent or a different therapeutic modality, e.g., anti-cancer agents, and/or in combination with surgical and/or radiation procedures.

For example, the second therapeutic agent can be a cytotoxic or a cytostatic agent. Exemplary cytotoxic agents include anti-microtubule agents, topoisomerase inhibitors, taxanes, antimetabolites, mitotic inhibitors, alkylating agents, intercalating agents, agents capable of interfering with a signal transduction pathway, and agents that promote apoptosis and radiation. In yet other embodiments, the methods can be used in combination with immunodulatory agents, e.g., IL-1, 2, 4, 6, or 12, or interferon alpha or gamma, or immune cell growth factors such as GM-CSF.

In some embodiments, the second therapeutic agent can be an immunotherapeutic or immunomodulating therapy, e.g., a compound-, antibody-, or cell-based immunotherapy. Examples of immunotherapies include, without limitation, a checkpoint inhibitor, cancer vaccine, cell-based therapy, T cell receptor (TCR)-based therapy, adjuvant immunotherapy, cytokine immunotherapy, or oncolytic virus therapy. In some embodiments, the cancer immunotherapy comprises a small molecule, nucleic acid, polypeptide, carbohydrate, toxin, cell-based, or binding agent therapeutic agent. Examples of cancer immunotherapies are described in greater detail infra but are not intended to be limiting.

In some embodiments, the cancer immunotherapy comprises a cancer vaccine. In some embodiments, the cancer immunotherapy comprises a cell-based therapy. In some embodiments, the cancer immunotherapy comprises a T cell-based therapy, e.g., a CD8+ or CD4+ T cell-based therapy. In some embodiments, the cancer immunotherapy comprises an adoptive T cell-based therapy. In some embodiments, the T cells are autologous or allogeneic to the recipient. In some embodiments, the T cell-based therapy comprises a chimeric antigen receptor (CAR)-T-based therapy. This approach involves engineering a CAR that specifically binds to an antigen of interest (e.g., a protein product of an oncogene described herein) and comprises one or more intracellular signaling domains for T cell activation. The CAR is then expressed on the surface of engineered T cells (CAR-T) and administered to a patient, leading to a T-cell-specific immune response against cancer cells expressing the antigen. In some embodiments, the T cell-based therapy comprises T cells expressing a recombinant T cell receptor (TCR). This approach involves identifying a TCR that specifically binds to an antigen of interest, which is then used to replace the endogenous or native TCR on the surface of engineered T cells that are administered to a patient, leading to a T-cell-specific immune response against cancer cells expressing the antigen. In some embodiments, the T cell-based therapy comprises tumor-infiltrating lymphocytes (TILs). For example, TILs can be isolated from a tumor or cancer of the present disclosure, then isolated and expanded in vitro. In some embodiments, the cell-based therapy comprises a dendritic cell-based therapy, e.g., a dendritic cell vaccine. Dendritic cell vaccines (such as Sipuleucel-T, also known as APC8015 and PROVENGE®) are vaccines that involve administration of dendritic cells that act as APCs to present one or more cancer-specific antigens, e.g., an oncogene of the present disclosure, to the patient's immune system. In some embodiments, the cancer immunotherapy comprises a TCR-based therapy. In some embodiments, the cancer immunotherapy comprises administration of one or more TCRs or TCR-based biologics that specifically bind an oncogenic protein product of the present disclosure. In some embodiments, the cancer immunotherapy comprises adjuvant immunotherapy. In some embodiments, the cancer immunotherapy comprises cytokine immunotherapy. In some embodiments, the cancer immunotherapy comprises oncolytic virus therapy.

In some embodiments, the cancer immunotherapy comprises a checkpoint inhibitor. As is known in the art, a checkpoint inhibitor targets at least one immune checkpoint protein to alter the regulation of an immune response, e.g., down-modulating or inhibiting an immune response. Immune checkpoint proteins include, e.g., CTLA4, PD-L1, PD-1, PD-L2, VISTA, B7-H2, B7-H3, B7-H4, B7-H6, 2B4, ICOS, HVEM, CEACAM, LAIR1, CD80, CD86, CD276, VTCN1, MHC class I, MHC class II, GALS, adenosine, TGFR, CSF1R, MICA/B, arginase, CD160, gp49B, PIR-B, KIR family receptors, TIM-1, TIM-3, TIM-4, LAG-3, BTLA, SIRPalpha (CD47), CD48, 2B4 (CD244), B7.1, B7.2, ILT-2, ILT-4, TIGIT, LAG-3, BTLA, IDO, OX40, and A2aR. In some embodiments, a checkpoint inhibitor decreases the activity of a checkpoint protein that negatively regulates immune cell function, e.g., in order to enhance T cell activation and/or an anti-cancer immune response; in other embodiments, a checkpoint inhibitor increases the activity of a checkpoint protein that positively regulates immune cell function, e.g., in order to enhance T cell activation and/or an anti-cancer immune response. In some embodiments, the checkpoint inhibitor is an antibody. In some embodiments, the checkpoint inhibitor is an antibody. Examples of checkpoint inhibitors include, without limitation, a PD-L1 axis binding antagonist (e.g., an anti-PD-L1 antibody, e.g., atezolizumab (MPDL3280A)), an antagonist directed against a co-inhibitory molecule (e.g., a CTLA4 antagonist (e.g., an anti-CTLA4 antibody), a TIM-3 antagonist (e.g., an anti-TIM-3 antibody), or a LAG-3 antagonist (e.g., an anti-LAG-3 antibody)), or any combination thereof. In some embodiments, the checkpoint inhibitor is an antagonist of CTLA4, such as a small molecule antagonist of CTLA4 or an anti-CTLA4 antibody, e.g., ipilimumab (YERVOY®; CAS Registry Number: 477202-00-9; also known as BMS-734016, MDX-010, and MDX-101).

Further provided are the targeted therapies of the present disclosure (e.g., a targeted therapy that inhibits expression and/or activity of a protein product of a fusion of the present disclosure) for use in any of the methods described herein. For example, a targeted therapy of the present disclosure may find use in a method of treating or delaying progression of cancer as described herein.

Yet further provided are the targeted therapies of the present disclosure (e.g., a targeted therapy that inhibits expression and/or activity of a protein product of an fusion of the present disclosure) for use in the manufacture of a medicament, e.g. for use in any of the methods described herein. For example, a targeted therapy of the present disclosure may find use in the manufacture of a medicament, e.g. for use in treating or delaying progression of cancer as described herein.

The targeted therapies described herein can be administered by any suitable method, including, for example, intravenously, intramuscularly, subcutaneously, intradermally, percutaneously, intraarterially, intraperitoneally, intralesionally, intracranially, intraarticularly, intraprostatically, intrapleurally, intratracheally, intrathecally, intranasally, intravaginally, intrarectally, topically, intratumorally, peritoneally, subconjunctival, intravesicularly, mucosally, intrapericardially, intraumbilically, intraocularly, intraorbitally, orally, topically, transdermal, intravitreally (e.g., by intravitreal injection), by eye drop, by inhalation, by injection, by implantation, by infusion, by continuous infusion, by localized perfusion bathing target cells directly, by catheter, by lavage, in cremes, or in lipid compositions. The targeted therapies described herein can also be administered systemically or locally. The method of administration can vary depending on various factors (e.g., the compound or composition being administered and the severity of the condition, disease, or disorder being treated). In some instances, the targeted therapy is administered intravenously, intramuscularly, subcutaneously, topically, orally, transdermal, intraperitoneally, intraorbitally, by implantation, by inhalation, intrathecally, intraventricularly, or intranasally. Dosing can be by any suitable route, e.g., by injections, such as intravenous or subcutaneous injections, depending in part on whether the administration is brief or chronic. Various dosing schedules including but not limited to single or multiple administrations over various time-points, bolus administration, and pulse infusion are contemplated herein.

Targeted therapies described herein (optionally comprising any additional therapeutic agent) may be formulated, dosed, and administered in a fashion consistent with good medical practice. Factors for consideration in this context include the particular disorder being treated, the particular subject being treated, the clinical condition of the individual patient, the cause of the disorder, the site of delivery of the agent, the method of administration, the scheduling of administration, and other factors known to medical practitioners. The therapeutic agent need not be, but is optionally formulated with and/or administered concurrently with one or more agents currently used to prevent or treat the disorder in question. The effective amount of such other agents depends on the amount of the targeted therapy present in the formulation, the type of disorder or treatment, and other factors discussed above. These are generally used in the same dosages and with administration routes as described herein, or about from 1 to 99% of the dosages described herein, or in any dosage and by any route that is empirically/clinically determined to be appropriate.

Nucleic Acid Samples

A variety of materials (such as tissues) can be the source of the nucleic acid samples used in the present methods. Genomic or subgenomic DNA fragments can be isolated from a subject's sample (e.g., a tumor sample, a normal adjacent tissue (NAT), a blood sample or any normal control)). In certain embodiments, the tissue is preserved as a frozen sample or as formaldehyde- or paraformaldehyde-fixed paraffin-embedded (FFPE) tissue preparation. For example, the sample can be embedded in a matrix, e.g., an FFPE block or a frozen sample. The isolating step can include flow-sorting of individual chromosomes; and/or micro-dissecting a subject's sample (e.g., a tumor sample, a NAT, or a blood sample). In some embodiments, the sample is free, or essentially free, of cells. In some embodiments, the sample comprises cell-free DNA (cfDNA) or circulating tumor DNA (ctDNA).

Protocols for DNA isolation from a tissue sample are known in the art. Additional methods to isolate nucleic acids (e.g., DNA) from formaldehyde- or paraformaldehyde-fixed, paraffin-embedded (FFPE) tissues are disclosed, e.g., in Cronin M. et al. (2004) *Am J Pathol.* 164(1):35-42; Masuda N. et al. (1999) *Nucleic Acids Res.* 27(22):4436-4443; Specht K. et al. (2001) *Am J Pathol.* 158(2):419-429, Ambion RecoverAll™ Total Nucleic Acid Isolation Protocol (Ambion, Cat. No. AM1975, September 2008), and QIAamp® DNA FFPE Tissue Handbook (Qiagen, Cat. No. 37625, October 2007), each of which is hereby incorporated by reference in its entirety. The RecoverAll™ Total Nucleic Acid Isolation Kit uses xylene at elevated temperatures to solubilize paraffin-embedded samples and a glass-fiber filter to capture nucleic acids. The QIAamp® DNA FFPE Tissue Kit uses QIAamp® DNA Micro technology for purification of genomic and mitochondrial DNA.

The nucleic acid samples (e.g., genomic DNA samples) can be fragmented or sheared by practicing routine techniques. For example, genomic DNA can be fragmented by physical shearing methods, enzymatic cleavage methods, chemical cleavage methods, and other methods well known to those skilled in the art.

Methods can further include isolating a nucleic acid sample to provide a library (e.g., a nucleic acid library). In certain embodiments, the nucleic acid sample includes whole genomic, subgenomic fragments, or both. The nucleic acid samples can be used to prepare nucleic acid libraries. Thus, in one embodiment, the methods featured in the disclosure further include isolating a nucleic acid sample to provide a library (e.g., a nucleic acid library as described herein). Protocols for isolating and preparing libraries from whole genomic or subgenomic fragments are known in the art (e.g., Illumina's genomic DNA sample preparation kit). The nucleic acid library can contain all or substantially all of the complexity of the genome. The term "substantially all" in this context refers to the possibility that there can in practice be some unwanted loss of genome complexity during isolation and/or preparation of the library. The methods described herein also are useful in cases where the nucleic acid library is a portion of the genome, i.e., where the complexity of the genome is reduced by design. In some embodiments, any selected portion of the genome can be used with the methods described herein. In some embodiments, the entire exome or a subset thereof is isolated. In certain embodiments, the genomic or subgenomic DNA fragment is isolated from a subject's sample (e.g., a tumor sample, a normal adjacent tissue (NAT), a blood sample or any normal control)). In one embodiment, the sample (e.g., the tumor or NAT sample) is a preserved. For example, the sample is embedded in a matrix, e.g., an FFPE block or a frozen sample. In certain embodiments, the isolating step includes flow-sorting of individual chromosomes; and/or microdissecting a subject's sample (e.g., a tumor sample, a NAT, a blood sample). In certain embodiments, the nucleic acid sample used to generate the nucleic acid library is less than 5 micrograms, less than 1 microgram, less than 500 ng, less than 200 ng, less than 100 ng, less than 50 ng or less than 20 ng (e.g., 10 ng or less).

In still other embodiments, the nucleic acid sample used to generate the library includes RNA or cDNA derived from RNA. In some embodiments, the RNA includes total cellular RNA. In other embodiments, certain abundant RNA sequences (e.g., ribosomal RNAs) have been depleted. In some embodiments, the poly(A)-tailed mRNA fraction in the total RNA preparation has been enriched. In some embodiments, the cDNA is produced by random-primed cDNA synthesis methods. In other embodiments, the cDNA synthesis is initiated at the poly(A) tail of mature mRNAs by priming by oligo(dT)-containing oligonucleotides. Methods for depletion, poly(A) enrichment, and cDNA synthesis are well known to those skilled in the art.

The method can further include amplifying the nucleic acid sample (e.g., a DNA or RNA sample) by specific or non-specific nucleic acid amplification methods that are well known to those skilled in the art. In some embodiments, the nucleic acid sample is amplified, e.g., by whole-genome amplification methods such as random-primed strand-displacement amplification.

In other embodiments, the nucleic acid sample is fragmented or sheared by physical or enzymatic methods and ligated to synthetic adapters, size-selected (e.g., by preparative gel electrophoresis) and amplified (e.g., by PCR). In other embodiments, the fragmented and adapter-ligated group of nucleic acids is used without explicit size selection or amplification prior to hybrid selection.

In other embodiments, the isolated DNA (e.g., the genomic DNA) is fragmented or sheared. In some embodiments, the library includes less than 50% of genomic DNA, such as a subfraction of genomic DNA that is a reduced representation or a defined portion of a genome, e.g., that has been subfractionated by other means. In other embodiments, the library includes all or substantially all genomic DNA.

In some embodiments, the library includes less than 50% of genomic DNA, such as a subfraction of genomic DNA that is a reduced representation or a defined portion of a genome, e.g., that has been subfractionated by other means. In other embodiments, the library includes all or substantially all genomic DNA. Alternative DNA shearing methods can be more automatable and/or more efficient (e.g., with degraded FFPE samples). Alternatives to DNA shearing methods can also be used to avoid a ligation step during library preparation.

The methods described herein can be performed using a small amount of nucleic acids, e.g., when the amount of source DNA is limiting (e.g., even after whole-genome amplification). In one embodiment, the nucleic acid comprises less than about 5 μg, 4 μg, 3 μg, 2 μg, 1 μg, 0.8 μg, 0.7 μg, 0.6 μg, 0.5 μg, or 400 ng, 300 ng, 200 ng, 100 ng, 50 ng, or 20 ng or less of nucleic acid sample. For example, to prepare 500 ng of hybridization-ready nucleic acids, one typically begins with 3 ag of genomic DNA. One can start with less, however, if one amplifies the genomic DNA (e.g., using PCR) before a hybridization step, e.g., a solution hybridization. Thus, it is possible, but not essential, to amplify the genomic DNA before hybridization, e.g., before solution hybridization.

In some embodiments, a library is generated using DNA (e.g., genomic DNA) from a sample tissue, and a corresponding library is generated with RNA (or cDNA) isolated from the same sample tissue.

Design of Baits

A bait can be a nucleic acid molecule, e.g., a DNA or RNA molecule, which can hybridize to (e.g., be complementary to), and thereby allow capture of a target nucleic acid. In one embodiment, a bait is an RNA molecule. In other embodiments, a bait includes a binding entity, e.g., an affinity tag, that allows capture and separation, e.g., by binding to a binding entity, of a hybrid formed by a bait and a nucleic acid hybridized to the bait. In one embodiment, a bait is suitable for solution phase hybridization.

Baits can be produced and used by methods and hybridization conditions as described in US 2010/0029498 and Gnirke, A. et al. (2009) *Nat Biotechnol.* 27(2):182-189, and U.S. Ser. No. 61/428,568, filed Dec. 30, 2010, incorporated herein by reference. For example, biotinylated RNA baits can be produced by obtaining a pool of synthetic long oligonucleotides, originally synthesized on a microarray, and amplifying the oligonucleotides to produce the bait sequences. In some embodiments, the baits are produced by adding an RNA polymerase promoter sequence at one end of the bait sequences, and synthesizing RNA sequences using RNA polymerase. In one embodiment, libraries of synthetic oligodeoxynucleotides can be obtained from commercial suppliers, such as Agilent Technologies, Inc., and amplified using known nucleic acid amplification methods.

Each bait sequence can include a target-specific (e.g., a member-specific) bait sequence and universal tails on each end. As used herein, the term “bait sequence” can refer to the target-specific bait sequence or the entire oligonucleotide including the target-specific “bait sequence” and other nucleotides of the oligonucleotide. In one embodiment, a target-specific bait hybridizes to a nucleotide sequence comprising a nucleotide sequence in an intron of one gene of a fusion molecule described herein, in an intron of the other gene of a fusion molecule described herein, or a fusion junction joining the introns. In one embodiment, the bait is an oligonucleotide of about 200 nucleotides, of which 170 nucleotides are target-specific “bait sequence”. The other 30 nucleotides (e.g., 15 nucleotides on each end) are universal arbitrary tails used for PCR amplification. The tails can be any sequence selected by the user.

The bait sequences described herein can be used for selection of exons and short target sequences. In one embodiment, the bait is between about 100 nucleotides and 300 nucleotides. In another embodiment, the bait is between about 130 nucleotides and 230 nucleotides. In yet another embodiment, the bait is between about 150 nucleotides and 200 nucleotides. The target-specific sequences in the baits, e.g., for selection of exons and short target sequences, are between about 40 nucleotides and 1000 nucleotides. In one embodiment, the target-specific sequence is between about 70 nucleotides and 300 nucleotides. In another embodiment, the target-specific sequence is between about 100 nucleotides and 200 nucleotides. In yet another embodiment, the target-specific sequence is between about 120 nucleotides and 170 nucleotides.

Sequencing Methods

The disclosure also includes methods of sequencing the fusion nucleic acid molecules described herein. In one embodiment, any of a variety of sequencing reactions known in the art can be used to directly sequence at least a portion of a fusion nucleic acid molecule described herein. In one embodiment, the fusion nucleotide sequence is compared to a corresponding reference (control) sequence.

In one embodiment, the sequence of the fusion nucleic acid molecule is determined by a method that includes one or more of: hybridizing an oligonucleotide, e.g., an allele specific oligonucleotide for one alteration described herein to said nucleic acid; hybridizing a primer, or a primer set (e.g., a primer pair), that amplifies a region comprising the mutation or a fusion junction of the allele; amplifying, e.g., specifically amplifying, a region comprising the mutation or a fusion junction of the allele; attaching an adapter oligonucleotide to one end of a nucleic acid that comprises the mutation or a fusion junction of the allele; generating an optical, e.g., a colorimetric signal, specific to the presence of the one of the mutation or fusion junction; hybridizing a nucleic acid comprising the mutation or fusion junction to a second nucleic acid, e.g., a second nucleic acid attached to a substrate; generating a signal, e.g., an electrical or fluorescent signal, specific to the presence of the mutation or fusion junction; and incorporating a nucleotide into an oligonucleotide that is hybridized to a nucleic acid that contains the mutation or fusion junction.

In another embodiment, the sequence is determined by a method that comprises one or more of: determining the nucleotide sequence from an individual nucleic acid molecule, e.g., where a signal corresponding to the sequence is derived from a single molecule as opposed, e.g., from a sum of signals from a plurality of clonally expanded molecules; determining the nucleotide sequence of clonally expanded proxies for individual nucleic acid molecules; massively parallel short-read sequencing; template-based sequencing; pyrosequencing; real-time sequencing comprising imaging the continuous incorporation of dye-labeling nucleotides during DNA synthesis; nanopore sequencing; sequencing by hybridization; nano-transistor array based sequencing; polony sequencing; scanning tunneling microscopy (STM) based sequencing; or nanowire-molecule sensor based sequencing.

Any method of sequencing known in the art can be used. Exemplary sequencing reactions include those based on techniques developed by Maxam and Gilbert (*Proc. Natl Acad Sci USA* (1977) 74:560) or Sanger (Sanger et al. (1977) *Proc. Nat. Acad. Sci* 74:5463). Any of a variety of automated sequencing procedures can be utilized when performing the assays (e.g., as disclosed in *Biotechniques* (1995) 19:448), including sequencing by mass spectrometry (see, for example, U.S. Pat. No. 5,547,835 and international patent application Publication Number WO 94/16101, entitled DNA Sequencing by Mass Spectrometry by H. Köster; U.S. Pat. No. 5,547,835 and international patent application Publication Number WO 94/21822 entitled DNA Sequencing by Mass Spectrometry Via Exonuclease Degradation by H. Köster), and U.S. Pat. No. 5,605,798 and International Patent Application No. PCT/US96/03651 entitled DNA Diagnostics Based on Mass Spectrometry by H. Köster; Cohen et al. (1996) *Adv Chromatogr* 36:127-162; and Griffin et al. (1993) Appl Biochem Biotechnol 38:147-159).

Sequencing of nucleic acid molecules can also be carried out using next-generation sequencing (NGS). Next-generation sequencing includes any sequencing method that determines the nucleotide sequence of either individual nucleic acid molecules or clonally expanded proxies for individual nucleic acid molecules in a highly parallel fashion (e.g., greater than 105 molecules are sequenced simultaneously). In one embodiment, the relative abundance of the nucleic acid species in the library can be estimated by counting the relative number of occurrences of their cognate sequences in the data generated by the sequencing experiment. Next generation sequencing methods are known in the art, and are described, e.g., in Metzker, M. (2010) *Nature Biotechnology Reviews* 11:31-46, incorporated herein by reference.

In one embodiment, the next-generation sequencing allows for the determination of the nucleotide sequence of an individual nucleic acid molecule (e.g., Helicos BioSciences' HeliScope Gene Sequencing system, and Pacific Biosciences' PacBio RS system). In other embodiments, the sequencing method determines the nucleotide sequence of clonally expanded proxies for individual nucleic acid molecules (e.g., the Solexa sequencer, Illumina Inc., San Diego, Calif.; 454 Life Sciences (Branford, Conn.), and Ion Torrent), e.g., massively parallel short-read sequencing (e.g., the Solexa sequencer, Illumina Inc., San Diego, Calif.), which generates more bases of sequence per sequencing unit than other sequencing methods that generate fewer but longer reads. Other methods or machines for next-generation sequencing include, e.g., the sequencers provided by 454 Life Sciences (Branford, Conn.), Applied Biosystems (Foster City, Calif.; SOLiD sequencer), and Helicos BioSciences Corporation (Cambridge, Mass.).

Platforms for next-generation sequencing include, e.g., Roche/454's Genome Sequencer (GS) FLX System, Illumina/Solexa's Genome Analyzer (GA), Illumina's HiSeq 2500, HiSeq 3000, HiSeq 4000 and NovaSeq 6000 Sequencing Systems, Life/APG's Support Oligonucleotide Ligation Detection (SOLiD) system, Polonator's G.007 system, Helicos BioSciences' HeliScope Gene Sequencing system, and Pacific Biosciences' PacBio RS system.

NGS technologies can include one or more of steps, e.g., template preparation, sequencing and imaging, and data analysis.

Template Preparation

Methods for template preparation can include steps such as randomly breaking nucleic acids (e.g., genomic DNA or cDNA) into smaller sizes and generating sequencing templates (e.g., fragment templates or mate-pair templates). The spatially separated templates can be attached or immobilized to a solid surface or support, allowing massive amounts of sequencing reactions to be performed simultaneously. Types of templates that can be used for NGS reactions include, e.g., clonally amplified templates originating from single DNA molecules, and single DNA molecule templates.

Methods for preparing clonally amplified templates include, e.g., emulsion PCR (emPCR) and solid-phase amplification.

EmPCR can be used to prepare templates for NGS. Typically, a library of nucleic acid fragments is generated, and adapters containing universal priming sites are ligated to the ends of the fragment. The fragments are then denatured into single strands and captured by beads. Each bead captures a single nucleic acid molecule. After amplification and enrichment of emPCR beads, a large amount of templates can be attached or immobilized in a polyacrylamide gel on a standard microscope slide (e.g., Polonator), chemically crosslinked to an amino-coated glass surface (e.g., Life/APG; Polonator), or deposited into individual PicoTiterPlate (PTP) wells (e.g., Roche/454), in which the NGS reaction can be performed.

Solid-phase amplification can also be used to produce templates for NGS. Typically, forward and reverse primers are covalently attached to a solid support. The surface density of the amplified fragments is defined by the ratio of the primers to the templates on the support. Solid-phase amplification can produce hundreds of millions spatially separated template clusters (e.g., Illumina/Solexa). The ends of the template clusters can be hybridized to universal sequencing primers for NGS reactions.

Other methods for preparing clonally amplified templates also include, e.g., Multiple Displacement Amplification (MDA) (Lasken R. S. *Curr Opin Microbiol.* 2007; 10(5): 510-6). MDA is a non-PCR based DNA amplification technique. The reaction involves annealing random hexamer primers to the template and DNA synthesis by a high fidelity enzyme, typically D29 at a constant temperature. MDA can generate large sized products with lower error frequency.

Template amplification methods such as PCR can be coupled with NGS platforms to target or enrich specific regions of the genome (e.g., exons). Exemplary template enrichment methods include, e.g., microdroplet PCR technology (Tewhey R. et al., *Nature Biotech.* 2009, 27:1025-1031), custom-designed oligonucleotide microarrays (e.g., Roche/NimbleGen oligonucleotide microarrays), and solution-based hybridization methods (e.g., molecular inversion probes (MIPs) (Porreca G. J. et al., *Nature Methods,* 2007, 4:931-936; Krishnakumar S. et al., *Proc. Natl. Acad. Sci. USA,* 2008, 105:9296-9310; Turner E. H. et al., *Nature Methods,* 2009, 6:315-316), and biotinylated RNA capture sequences (Gnirke A. et al., *Nat. Biotechnol.* 2009; 27(2): 182-9)

Single-molecule templates are another type of templates that can be used for NGS reactions. Spatially separated single molecule templates can be immobilized on solid supports by various methods. In one approach, individual primer molecules are covalently attached to the solid support. Adapters are added to the templates and templates are then hybridized to the immobilized primers. In another approach, single-molecule templates are covalently attached to the solid support by priming and extending single-stranded, single-molecule templates from immobilized primers. Universal primers are then hybridized to the templates. In yet another approach, single polymerase molecules are attached to the solid support, to which primed templates are bound.

Sequencing and Imaging

Exemplary sequencing and imaging steps for NGS include, e.g., cyclic reversible termination (CRT), sequencing by ligation (SBL), single-molecule addition (pyrosequencing), and real-time sequencing.

CRT uses reversible terminators in a cyclic method that minimally includes the steps of nucleotide incorporation, fluorescence imaging, and cleavage. Typically, a DNA polymerase incorporates a single fluorescently modified nucleotide corresponding to the complementary nucleotide of the template base to the primer. DNA synthesis is terminated after the addition of a single nucleotide and the unincorporated nucleotides are washed away. Imaging is performed to determine the identity of the incorporated labeled nucleotide. Then in the cleavage step, the terminating/inhibiting group and the fluorescent dye are removed. Exemplary NGS platforms using the CRT method include, e.g., Illumina/Solexa Genome Analyzer (GA), which uses the clonally amplified template method coupled with the four-color CRT method detected by total internal reflection fluorescence (TIRF); and Helicos BioSciences/HeliScope, which uses the single-molecule template method coupled with the one-color CRT method detected by TIRF.

SBL uses DNA ligase and either one-base-encoded probes or two-base-encoded probes for sequencing. Typically, a fluorescently labeled probe is hybridized to its complementary sequence adjacent to the primed template. DNA ligase is used to ligate the fluorescent dye-labeled probe to the primer. Fluorescence imaging is performed to determine the identity of the ligated probe after non-ligated probes are washed away. The fluorescent dye can be removed by using cleavable probes to regenerate a 5'-$PO_4$ group for subsequent ligation cycles. Alternatively, a new primer can be hybridized to the template after the old primer is removed. Exemplary SBL platforms include, e.g., Life/APG/SOLiD (support oligonucleotide ligation detection), which uses two-base-encoded probes.

Pyrosequencing method is based on detecting the activity of DNA polymerase with another chemiluminescent enzyme. Typically, the method allows sequencing of a single strand of DNA by synthesizing the complementary strand along it, one base pair at a time, and detecting which base was actually added at each step. The template DNA is immobile, and solutions of A, C, G, and T nucleotides are sequentially added and removed from the reaction. Light is produced only when the nucleotide solution complements the first unpaired base of the template. The sequence of solutions which produce chemiluminescent signals allows the determination of the sequence of the template. Exemplary pyrosequencing platforms include, e.g., Roche/454, which uses DNA templates prepared by emPCR with 1-2 million beads deposited into PTP wells.

Real-time sequencing involves imaging the continuous incorporation of dye-labeled nucleotides during DNA synthesis. Exemplary real-time sequencing platforms include, e.g., Pacific Biosciences platform, which uses DNA polymerase molecules attached to the surface of individual zero-mode waveguide (ZMW) detectors to obtain sequence information when phospholinked nucleotides are being incorporated into the growing primer strand; Life/VisiGen platform, which uses an engineered DNA polymerase with an attached fluorescent dye to generate an enhanced signal after nucleotide incorporation by fluorescence resonance energy transfer (FRET); and LI-COR Biosciences platform, which uses dye-quencher nucleotides in the sequencing reaction.

Other sequencing methods for NGS include, e.g., nanopore sequencing, sequencing by hybridization, nano-transistor array-based sequencing, polony sequencing, scanning tunneling microscopy (STM) based sequencing, and nanowire-molecule sensor based sequencing.

Nanopore sequencing involves electrophoresis of nucleic acid molecules in solution through a nano-scale pore which provides a highly confined space within which single-nucleic acid polymers can be analyzed. Exemplary methods of nanopore sequencing are described, e.g., in Branton D. et al., *Nat Biotechnol.* 2008; 26(10):1146-53.

Sequencing by hybridization is a non-enzymatic method that uses a DNA microarray. Typically, a single pool of DNA is fluorescently labeled and hybridized to an array containing known sequences. Hybridization signals from a given spot on the array can identify the DNA sequence. The binding of one strand of DNA to its complementary strand in the DNA double-helix is sensitive to even single-base mismatches when the hybrid region is short or if specialized mismatch detection proteins are present. Exemplary methods of sequencing by hybridization are described, e.g., in Hanna G. J. et al., *J. Clin. Microbiol.* 2000; 38 (7): 2715-21; and Edwards J. R. et al., *Mut. Res.* 2005; 573 (1-2): 3-12.

Polony sequencing is based on polony amplification and sequencing-by-synthesis via multiple single-base-extensions (FISSEQ). Polony amplification is a method to amplify DNA in situ on a polyacrylamide film. Exemplary polony sequencing methods are described, e.g., in US Patent Application Publication No. 2007/0087362.

Nano-transistor array-based devices, such as Carbon NanoTube Field Effect Transistor (CNTFET), can also be used for NGS. For example, DNA molecules are stretched and driven over nanotubes by micro-fabricated electrodes. DNA molecules sequentially come into contact with the carbon nanotube surface, and the difference in current flow from each base is produced due to charge transfer between the DNA molecule and the nanotubes. DNA is sequenced by recording these differences. Exemplary nano-transistor array based sequencing methods are described, e.g., in U.S. Patent Application Publication No. 2006/0246497.

Scanning tunneling microscopy (STM) can also be used for NGS. STM uses a piezo-electric-controlled probe that performs a raster scan of a specimen to form images of its surface. STM can be used to image the physical properties of single DNA molecules, e.g., generating coherent electron tunneling imaging and spectroscopy by integrating scanning tunneling microscope with an actuator-driven flexible gap. Exemplary sequencing methods using STM are described, e.g., in U.S. Patent Application Publication No. 2007/0194225.

A molecular-analysis device which is comprised of a nanowire-molecule sensor can also be used for NGS. Such device can detect the interactions of the nitrogenous material disposed on the nanowires and nucleic acid molecules such as DNA. A molecule guide is configured for guiding a molecule near the molecule sensor, allowing an interaction and subsequent detection. Exemplary sequencing methods using nanowire-molecule sensor are described, e.g., in U.S. Patent Application Publication No. 2006/0275779.

Double ended sequencing methods can be used for NGS. Double ended sequencing uses blocked and unblocked primers to sequence both the sense and antisense strands of DNA. Typically, these methods include the steps of annealing an unblocked primer to a first strand of nucleic acid; annealing a second blocked primer to a second strand of nucleic acid; elongating the nucleic acid along the first strand with a polymerase; terminating the first sequencing primer; deblocking the second primer; and elongating the nucleic acid along the second strand. Exemplary double ended sequencing methods are described, e.g., in U.S. Pat. No. 7,244,567.

Data Analysis

After NGS reads have been generated, they can be aligned to a known reference sequence or assembled de novo.

For example, identifying genetic variations such as single-nucleotide polymorphism and structural variants in a sample (e.g., a tumor sample) can be accomplished by aligning NGS reads to a reference sequence (e.g., a wildtype sequence). Methods of sequence alignment for NGS are described e.g., in Trapnell C. and Salzberg S. L. *Nature Biotech.,* 2009, 27:455-457.

Examples of de novo assemblies are described, e.g., in Warren R. et al., *Bioinformatics,* 2007, 23:500-501; Butler J. et al., *Genome Res.,* 2008, 18:810-820; and Zerbino D. R. and Birney E., *Genome Res.,* 2008, 18:821-829.

Sequence alignment or assembly can be performed using read data from one or more NGS platforms, e.g., mixing Roche/454 and Illumina/Solexa read data.

Algorithms and methods for data analysis are described in U.S. Ser. No. 61/428,568, filed Dec. 30, 2010, incorporated herein by reference.

To determine the percent identity of two amino acid sequences or of two nucleic acids, the sequences are aligned for optimal comparison purposes (e.g., gaps can be introduced in the sequence of a first amino acid or nucleotide sequence for optimal alignment with a second amino or nucleotide sequence). The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences (i.e., % identity=# of identical positions/total # of positions (e.g., overlapping positions)×100). In one embodiment the two sequences are the same length.

The determination of percent identity between two sequences can be accomplished using a mathematical algorithm. A non-limiting example of a mathematical algorithm utilized for the comparison of two sequences is the algorithm of Karlin and Altschul (1990) *Proc. Natl. Acad. Sci. USA* 87:2264-2268, modified as in Karlin and Altschul (1993) *Proc. Natl. Acad. Sci. USA* 90:5873-5877. Such an algorithm is incorporated into the NBLAST and XBLAST programs of Altschul, et al. (1990) *J Mol. Biol.* 215:403-410. BLAST nucleotide searches can be performed with the NBLAST program, score=100, wordlength=12 to obtain nucleotide sequences homologous to a nucleic acid molecule featured in the disclosure. BLAST protein searches can be performed with the XBLAST program, score=50, word length=3 to obtain amino acid sequences homologous to protein molecules featured in the disclosure. To obtain gapped alignments for comparison purposes, Gapped BLAST can be utilized as described in Altschul et al. (1997) *Nucleic Acids Res.* 25:3389-3402. Alternatively, PSI-Blast can be used to perform an iterated search which detects distant relationships between molecules. When utilizing BLAST, Gapped BLAST, and PSI-Blast programs, the default parameters of the respective programs (e.g., XBLAST and NBLAST) can be used. See http://www.ncbi.nlm.nih.gov. Another non-limiting example of a mathematical algorithm utilized for the comparison of sequences is the algorithm of Myers and Miller (1988) *Comput Appl Biosci,* 4:11-7. Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Yet another useful algorithm for identifying regions of local sequence similarity and alignment is the FASTA algorithm as described in Pearson and Lipman (1988) *Proc. Natl. Acad. Sci. USA* 85:2444-2448. When using the FASTA algorithm for comparing nucleotide or amino acid sequences, a PAM120 weight residue table can, for example, be used with a k-tuple value of 2.

The percent identity between two sequences can be determined using techniques similar to those described above, with or without allowing gaps. In calculating percent identity, only exact matches are counted.

Expression of Fusion Molecules

In certain embodiments, expression level of a fusion nucleic acid molecule or polypeptide described herein can be assayed. Fusion expression can be assessed by any of a wide variety of methods for detecting expression of a transcribed nucleic acid molecule or translated protein. Non-limiting examples of such methods include immunological methods for detection of secreted, cell-surface, cytoplasmic, or nuclear proteins, protein purification methods, protein function or activity assays, nucleic acid hybridization methods, nucleic acid reverse transcription methods, and nucleic acid amplification methods.

In certain embodiments, activity of a particular gene is characterized by a measure of gene transcript (e.g., mRNA), by a measure of the quantity of translated protein, or by a measure of gene product activity. Fusion expression can be monitored in a variety of ways, including by detecting mRNA levels, protein levels, or protein activity, any of which can be measured using standard techniques. Detection can involve quantification of the level of gene expression (e.g., genomic DNA, cDNA, mRNA, protein, or enzyme activity), or, alternatively, can be a qualitative assessment of the level of gene expression, in particular, in comparison with a control level. The type of level being detected will be clear from the context.

Methods of detecting and/or quantifying the fusion gene transcript (mRNA or cDNA made therefrom) using nucleic acid hybridization techniques are known to those of skill in the art (see Sambrook et al. supra). For example, one method for evaluating the presence, absence, or quantity of cDNA involves a Southern transfer. Briefly, the mRNA is isolated (e.g., using an acid guanidinium-phenol-chloroform extraction method, Sambrook et al. supra.) and reverse transcribed to produce cDNA. The cDNA is then optionally digested and run on a gel in buffer and transferred to membranes. Hybridization is then carried out using the nucleic acid probes specific for the cDNA of a fusion molecule described herein, e.g., using the probes and primers described herein.

In other embodiments, expression of a fusion molecule described herein is assessed by preparing genomic DNA or mRNA/cDNA (i.e., a transcribed polynucleotide) from cells in a subject sample, and by hybridizing the genomic DNA or mRNA/cDNA with a reference polynucleotide which is a complement of a polynucleotide comprising the fusion, or a fragment thereof. cDNA can, optionally, be amplified using any of a variety of polymerase chain reaction (PCR) methods prior to hybridization with the reference polynucleotide. Expression of a fusion as described herein can likewise be detected using quantitative PCR (QPCR) to assess the level of expression.

Antibodies

An antibody according to any of the above embodiments may incorporate any of the features, singly or in combination, as described below:

1. Antibody Affinity

In certain embodiments, an antibody provided herein has a dissociation constant (Kd) of ≤1 μM, ≤100 nM, ≤10 nM, ≤1 nM, ≤0.1 nM, ≤0.01 nM, or ≤0.001 nM (e.g. $10^{-8}$ M or less, e.g. from $10^{-8}$ M to $10^{-13}$ M, e.g., from $10^{-9}$ M to $10^{-13}$ M).

In one embodiment, Kd is measured by a radiolabeled antigen binding assay (RIA). In one embodiment, an RIA is performed with the Fab version of an antibody of interest and its antigen. For example, solution binding affinity of Fabs for antigen is measured by equilibrating Fab with a minimal concentration of ($^{125}$I)-labeled antigen in the presence of a titration series of unlabeled antigen, then capturing bound antigen with an anti-Fab antibody-coated plate (see, e.g., Chen et al., *J. Mol. Biol.* 293:865-881(1999)). To establish conditions for the assay, MICROTITER® multi-well plates (Thermo Scientific) are coated overnight with 5 μg/ml of a capturing anti-Fab antibody (Cappel Labs) in 50 mM sodium carbonate (pH 9.6), and subsequently blocked with 2% (w/v) bovine serum albumin in PBS for two to five hours at room temperature (approximately 23° C.). In a non-adsorbent plate (Nunc #269620), 100 μM or 26 μM [$^{125}$I]-antigen are mixed with serial dilutions of a Fab of interest (e.g., consistent with assessment of the anti-VEGF antibody, Fab-12, in Presta et al., *Cancer Res.* 57:4593-4599 (1997)). The Fab of interest is then incubated overnight; however, the incubation may continue for a longer period (e.g., about 65 hours) to ensure that equilibrium is reached. Thereafter, the mixtures are transferred to the capture plate for incubation at room temperature (e.g., for one hour). The solution is then removed and the plate washed eight times with 0.1% polysorbate 20 (TWEEN-20®) in PBS. When the plates have dried, 150 l/well of scintillant (MICROSCINT-20™; Packard) is added, and the plates are counted on a TOPCOUNT m gamma counter (Packard) for ten minutes. Concentrations of each Fab that give less than or equal to 20% of maximal binding are chosen for use in competitive binding assays.

According to another embodiment, Kd is measured using a BIACORE® surface plasmon resonance assay. For example, an assay using a BIACORE®-2000 or a BIACORE®-3000 (BIAcore, Inc., Piscataway, NJ) is performed at 25° C. with immobilized antigen CM5 chips at ~10 response units (RU). In one embodiment, carboxymethylated dextran biosensor chips (CM5, BIACORE, Inc.) are activated with N-ethyl-N'-(3-dimethylaminopropyl)-carbodiimide hydrochloride (EDC) and N-hydroxysuccinimide (NHS) according to the supplier's instructions. Antigen is diluted with 10 mM sodium acetate, pH 4.8, to 5 μg/ml (~0.2 μM) before injection at a flow rate of 5 μl/minute to achieve approximately 10 response units (RU) of coupled protein. Following the injection of antigen, 1 M ethanolamine is injected to block unreacted groups. For kinetics measurements, two-fold serial dilutions of Fab (0.78 nM to 500 nM) are injected in PBS with 0.05% polysorbate 20 (TWEEN-20m) surfactant (PBST) at 25° C. at a flow rate of approximately 25 μl/min. Association rates ($k_{on}$) and dissociation rates ($k_{off}$) are calculated using a simple one-to-one Langmuir binding model (BIACORE® Evaluation Software version 3.2) by simultaneously fitting the association and dissociation sensorgrams. The equilibrium dissociation constant (Kd) is calculated as the ratio $k_{off}/k_{on}$. See, e.g., Chen et al., *J. Mol. Biol.* 293:865-881 (1999). If the on-rate exceeds 106 M-1 s-1 by the surface plasmon resonance assay above, then the on-rate can be determined by using a fluorescent quenching technique that measures the increase or decrease in fluorescence emission intensity (excitation=295 nm; emission=340 nm, 16 nm band-pass) at 25° C. of a 20 nM anti-antigen antibody (Fab form) in PBS, pH 7.2, in the presence of increasing concentrations of antigen as measured in a spectrometer, such as a stop-flow equipped spectrophometer (Aviv Instruments) or a 8000-series SLM-AMINCO™ spectrophotometer (ThermoSpectronic) with a stirred cuvette.

2. Antibody Fragments

In certain embodiments, an antibody provided herein is an antibody fragment. Antibody fragments include, but are not limited to, Fab, Fab', Fab'-SH, $F(ab')_2$, Fv, and scFv fragments, and other fragments described below. For a review of certain antibody fragments, see Hudson et al. *Nat. Med.* 9:129-134 (2003). For a review of scFv fragments, see, e.g., Pluckthün, in *The Pharmacology of Monoclonal Antibodies*, vol. 113, Rosenburg and Moore eds., (Springer-Verlag, New York), pp. 269-315 (1994); see also WO 93/16185; and U.S. Pat. Nos. 5,571,894 and 5,587,458. For discussion of Fab and $F(ab')_2$ fragments comprising salvage receptor binding epitope residues and having increased in vivo half-life, see U.S. Pat. No. 5,869,046.

Diabodies are antibody fragments with two antigen-binding sites that may be bivalent or bispecific. See, for example, EP 404,097; WO 1993/01161; Hudson et al., *Nat. Med.* 9:129-134 (2003); and Hollinger et al., *Proc. Natl. Acad. Sci. USA* 90: 6444-6448 (1993). Triabodies and tetrabodies are also described in Hudson et al., *Nat. Med.* 9:129-134 (2003).

Single-domain antibodies are antibody fragments comprising all or a portion of the heavy chain variable domain or all or a portion of the light chain variable domain of an antibody. In certain embodiments, a single-domain antibody is a human single-domain antibody (Domantis, Inc., Waltham, MA; see, e.g., U.S. Pat. No. 6,248,516 B1).

Antibody fragments can be made by various techniques, including but not limited to proteolytic digestion of an intact antibody as well as production by recombinant host cells (e.g. *E. coli* or phage), as described herein.

3. Chimeric and Humanized Antibodies

In certain embodiments, an antibody provided herein is a chimeric antibody. Certain chimeric antibodies are described, e.g., in U.S. Pat. No. 4,816,567; and Morrison et al., *Proc. Natl. Acad. Sci. USA,* 81:6851-6855 (1984)). In one example, a chimeric antibody comprises a non-human variable region (e.g., a variable region derived from a mouse, rat, hamster, rabbit, or non-human primate, such as a monkey) and a human constant region. In a further example, a chimeric antibody is a "class switched" antibody in which the class or subclass has been changed from that of the parent antibody. Chimeric antibodies include antigen-binding fragments thereof.

In certain embodiments, a chimeric antibody is a humanized antibody. Typically, a non-human antibody is humanized to reduce immunogenicity to humans, while retaining the specificity and affinity of the parental non-human antibody. Generally, a humanized antibody comprises one or more variable domains in which HVRs, e.g., CDRs, (or portions thereof) are derived from a non-human antibody, and FRs (or portions thereof) are derived from human antibody sequences. A humanized antibody optionally will also comprise at least a portion of a human constant region. In some embodiments, some FR residues in a humanized antibody are substituted with corresponding residues from a non-human antibody (e.g., the antibody from which the HVR residues are derived), e.g., to restore or improve antibody specificity or affinity.

Humanized antibodies and methods of making them are reviewed, e.g., in Almagro and Fransson, *Front. Biosci.*

13:1619-1633 (2008), and are further described, e.g., in Riechmann et al., Nature 332:323-329 (1988); Queen et al., *Proc. Nat'l Acad. Sci. USA* 86:10029-10033 (1989); U.S. Pat. Nos. 5,821,337, 7,527,791, 6,982,321, and 7,087,409; Kashmiri et al., *Methods* 36:25-34 (2005) (describing specificity determining region (SDR) grafting); Padlan, *Mol. Immunol.* 28:489-498 (1991) (describing "resurfacing"); Dall'Acqua et al., *Methods* 36:43-60 (2005) (describing "FR shuffling"); and Osbourn et al., *Methods* 36:61-68 (2005) and Klimka et al., *Br. J Cancer,* 83:252-260 (2000) (describing the "guided selection" approach to FR shuffling).

Human framework regions that may be used for humanization include but are not limited to: framework regions selected using the "best-fit" method (see, e.g., Sims et al. *J. Immunol.* 151:2296 (1993)); framework regions derived from the consensus sequence of human antibodies of a particular subgroup of light or heavy chain variable regions (see, e.g., Carter et al. *Proc. Natl. Acad. Sci. USA,* 89:4285 (1992); and Presta et al. *J Immunol.,* 151:2623 (1993)); human mature (somatically mutated) framework regions or human germline framework regions (see, e.g., Almagro and Fransson, *Front. Biosci.* 13:1619-1633 (2008)); and framework regions derived from screening FR libraries (see, e.g., Baca et al., *J. Biol. Chem.* 272:10678-10684 (1997) and Rosok et al., *J. Biol. Chem.* 271:22611-22618 (1996)).

4. Human Antibodies

In certain embodiments, an antibody provided herein is a human antibody. Human antibodies can be produced using various techniques known in the art. Human antibodies are described generally in van Dijk and van de Winkel, *Curr. Opin. Pharmacol.* 5: 368-74 (2001) and Lonberg, *Curr. Opin. Immunol.* 20:450-459 (2008).

Human antibodies may be prepared by administering an immunogen to a transgenic animal that has been modified to produce intact human antibodies or intact antibodies with human variable regions in response to antigenic challenge. Such animals typically contain all or a portion of the human immunoglobulin loci, which replace the endogenous immunoglobulin loci, or which are present extrachromosomally or integrated randomly into the animal's chromosomes. In such transgenic mice, the endogenous immunoglobulin loci have generally been inactivated. For review of methods for obtaining human antibodies from transgenic animals, see Lonberg, *Nat. Biotech.* 23:1117-1125 (2005). See also, e.g., U.S. Pat. Nos. 6,075,181 and 6,150,584 describing XENOMOUSE™ technology; U.S. Pat. No. 5,770,429 describing HUMAB® technology; U.S. Pat. No. 7,041,870 describing K-M MOUSE® technology, and U.S. Patent Application Publication No. US 2007/0061900, describing VELOCIMOUSE® technology). Human variable regions from intact antibodies generated by such animals may be further modified, e.g., by combining with a different human constant region.

Human antibodies can also be made by hybridoma-based methods. Human myeloma and mouse-human heteromyeloma cell lines for the production of human monoclonal antibodies have been described. (See, e.g., Kozbor *J. Immunol.,* 133: 3001 (1984); Brodeur et al., *Monoclonal Antibody Production Techniques and Applications*, pp. 51-63 (Marcel Dekker, Inc., New York, 1987); and Boerner et al., *J Immunol.,* 147: 86 (1991).) Human antibodies generated via human B-cell hybridoma technology are also described in Li et al., *Proc. Natl. Acad. Sci. USA,* 103:3557-3562 (2006). Additional methods include those described, for example, in U.S. Pat. No. 7,189,826 (describing production of monoclonal human IgM antibodies from hybridoma cell lines) and Ni, *Xiandai Mianyixue,* 26(4):265-268 (2006) (describing human-human hybridomas). Human hybridoma technology (Trioma technology) is also described in Vollmers and Brandlein, *Histology and Histopathology,* 20(3):927-937 (2005) and Vollmers and Brandlein, *Methods and Findings in Experimental and Clinical Pharmacology,* 27(3): 185-91 (2005).

Human antibodies may also be generated by isolating Fv clone variable domain sequences selected from human-derived phage display libraries. Such variable domain sequences may then be combined with a desired human constant domain. Techniques for selecting human antibodies from antibody libraries are described below.

5. Library-Derived Antibodies

Antibodies of the invention may be isolated by screening combinatorial libraries for antibodies with the desired activity or activities. For example, a variety of methods are known in the art for generating phage display libraries and screening such libraries for antibodies possessing the desired binding characteristics. Such methods are reviewed, e.g., in Hoogenboom et al. in *Methods in Molecular Biology* 178: 1-37 (O'Brien et al., ed., Human Press, Totowa, NJ, 2001) and further described, e.g., in the McCafferty et al., *Nature* 348:552-554; Clackson et al., *Nature* 352: 624-628 (1991); Marks et al., *J. Mol. Biol.* 222: 581-597 (1992); Marks and Bradbury, in *Methods in Molecular Biology* 248:161-175 (Lo, ed., Human Press, Totowa, NJ, 2003); Sidhu et al., *J Mol. Biol.* 338(2): 299-310 (2004); Lee et al., *J Mol. Biol.* 340(5): 1073-1093 (2004); *Fellouse, Proc. Natl. Acad. Sci. USA* 101(34): 12467-12472 (2004); and Lee et al., *J Immunol. Methods* 284(1-2): 119-132(2004).

In certain phage display methods, repertoires of VH and VL genes are separately cloned by polymerase chain reaction (PCR) and recombined randomly in phage libraries, which can then be screened for antigen-binding phage as described in Winter et al., *Ann. Rev. Immunol.,* 12: 433-455 (1994). Phage typically display antibody fragments, either as single-chain Fv (scFv) fragments or as Fab fragments. Libraries from immunized sources provide high-affinity antibodies to the immunogen without the requirement of constructing hybridomas. Alternatively, the naive repertoire can be cloned (e.g., from human) to provide a single source of antibodies to a wide range of non-self and also self antigens without any immunization as described by Griffiths et al., *EMBO J,* 12: 725-734 (1993). Finally, naive libraries can also be made synthetically by cloning unrearranged V-gene segments from stem cells, and using PCR primers containing random sequence to encode the highly variable CDR3 regions and to accomplish rearrangement in vitro, as described by Hoogenboom and Winter, *J Mol. Biol.,* 227: 381-388 (1992). Patent publications describing human antibody phage libraries include, for example: U.S. Pat. No. 5,750,373, and US Patent Publication Nos. 2005/0079574, 2005/0119455, 2005/0266000, 2007/0117126, 2007/0160598, 2007/0237764, 2007/0292936, and 2009/0002360.

Antibodies or antibody fragments isolated from human antibody libraries are considered human antibodies or human antibody fragments herein.

6. Multispecific Antibodies

In certain embodiments, an antibody provided herein is a multispecific antibody, e.g. a bispecific antibody. Multispecific antibodies are monoclonal antibodies that have binding specificities for at least two different sites. In certain embodiments, one of the binding specificities is for an immune checkpoint protein of the present disclosure and the other is for any other antigen. Bispecific antibodies can be prepared as full length antibodies or antibody fragments.

Techniques for making multispecific antibodies include, but are not limited to, recombinant co-expression of two immunoglobulin heavy chain-light chain pairs having different specificities (see Milstein and Cuello, *Nature* 305: 537 (1983)), WO 93/08829, and Traunecker et al., *EMBO J.* 10: 3655 (1991)), and "knob-in-hole" engineering (see, e.g., U.S. Pat. No. 5,731,168). Multi-specific antibodies may also be made by engineering electrostatic steering effects for making antibody Fc-heterodimeric molecules (WO 2009/089004A1); cross-linking two or more antibodies or fragments (see, e.g., U.S. Pat. No. 4,676,980, and Brennan et al., *Science,* 229: 81 (1985)); using leucine zippers to produce bi-specific antibodies (see, e.g., Kostelny et al., *J. Immunol.,* 148(5):1547-1553 (1992)); using "diabody" technology for making bispecific antibody fragments (see, e.g., Hollinger et al., *Proc. Natl. Acad. Sci. USA,* 90:6444-6448 (1993)); and using single-chain Fv (sFv) dimers (see, e.g. Gruber et al., *J Immunol.,* 152:5368 (1994)); and preparing trispecific antibodies as described, e.g., in Tutt et al. *J Immunol.* 147: 60 (1991).

Engineered antibodies with three or more functional antigen binding sites, including "Octopus antibodies," are also included herein (see, e.g. US 2006/0025576A1).

The antibody or fragment herein also includes a "Dual Acting FAb" or "DAF" comprising an antigen binding site that binds to an immune checkpoint protein as well as another, different antigen (see, US 2008/0069820, for example).

7. Antibody Variants

In certain embodiments, amino acid sequence variants of the antibodies provided herein are contemplated. For example, it may be desirable to improve the binding affinity and/or other biological properties of the antibody. Amino acid sequence variants of an antibody may be prepared by introducing appropriate modifications into the nucleotide sequence encoding the antibody, or by peptide synthesis. Such modifications include, for example, deletions from, and/or insertions into and/or substitutions of residues within the amino acid sequences of the antibody. Any combination of deletion, insertion, and substitution can be made to arrive at the final construct, provided that the final construct possesses the desired characteristics, e.g., antigen-binding.

a) Substitution, Insertion, and Deletion Variants

In certain embodiments, antibody variants having one or more amino acid substitutions are provided. Sites of interest for substitutional mutagenesis include the HVRs and FRs. Conservative substitutions are shown in Table P under the heading of "conservative substitutions. More substantial changes are provided in Table P under the heading of "other exemplary substitutions," and as further described below in reference to amino acid side chain classes. Amino acid substitutions may be introduced into an antibody of interest and the products screened for a desired activity, e.g., retained/improved antigen binding, decreased immunogenicity, or improved ADCC or CDC.

In some embodiments, an isolated antibody molecule provided herein comprises a label or a tag. In some embodiments, the label or tag comprises a detection agent, such as a fluorescent molecule or an affinity reagent or tag. In some embodiments, an isolated antibody molecule provided herein is conjugated to a drug molecule, e.g., an anti-cancer agent, a cytotoxic agent such as mertansine or monomethyl auristatin E (MMAE).

In some embodiments, an anti-cancer agent provided herein is an immunotherapy. In some embodiments, an immunotherapy comprises one or more of: a checkpoint inhibitor, cancer vaccine, cell-based therapy, T cell receptor (TCR)-based therapy, adjuvant immunotherapy, cytokine immunotherapy, and oncolytic virus therapy. In some embodiments, the immunotherapy comprises small molecule, nucleic acid, polypeptide, carbohydrate, toxin, cell-based, or binding agent therapeutic agent. In some embodiments, the cancer immunotherapy activates one or more aspects of the immune system to attack a cell (e.g., a tumor cell). The cancer immunotherapies of the present disclosure are contemplated for use as monotherapies, or in combination approaches comprising two or more in any combination or number, subject to medical judgement. Any of the cancer immunotherapies (optionally as monotherapies or in combination with another cancer immunotherapy or other therapeutic agent described herein) may find use in any of the methods described herein.

In some embodiments, an anti-cancer agent provided herein comprises a vaccine. In some embodiments, the cancer vaccine comprises a polynucleotide that encodes a neoantigen as well as one or more additional antigens, neoantigens, or other sequences that promote antigen presentation and/or an immune response. In some embodiments, the vaccine is provided in a liposome or lipoplex.

In some embodiments, an anti-cancer agent provided herein comprises a cell-based therapy. In some embodiments, the cell-base therapy is a T cell-based therapy, e.g., an adoptive T cell-based therapy. In some embodiments, the T cells are autologous or allogeneic to the recipient. In some embodiments, the T cells are CD8+ T cells. In some embodiments, the T cells are CD4+ T cells. In some embodiments, the T cell-based therapy comprises a chimeric antigen receptor (CAR)-T-based therapy. This approach involves engineering a CAR that specifically binds to an antigen of interest and comprises one or more intracellular signaling domains for T cell activation. The CAR is then expressed on the surface of engineered T cells (CAR-T) and administered to a patient, leading to a T-cell-specific immune response against cancer cells expressing the antigen. In some embodiments, the T cell-based therapy comprises T cells expressing a recombinant T cell receptor (TCR). This approach involves identifying a TCR that specifically binds to an antigen of interest, which is then used to replace the endogenous or native TCR on the surface of engineered T cells that are administered to a patient, leading to a T-cell-specific immune response against cancer cells expressing the antigen.

In some embodiments, the T cell-based therapy comprises tumor-infiltrating lymphocytes (TILs). For example, TILs can be isolated from a tumor or cancer of the present disclosure, then isolated and expanded in vitro. TILs are then administered to the patient (optionally in combination with one or more cytokines or other immune-stimulating substances).

In some embodiments, a cell-based therapy provided herein comprises a dendritic cell-based therapy, e.g., a dendritic cell vaccine. Dendritic cell vaccines (such as Sipuleucel-T, also known as APC8015 and PROVENGE®) are vaccines that involve administration of dendritic cells that act as APCs to present one or more cancer-specific antigens to the patient's immune system. In some embodiments, the dendritic cells are autologous or allogeneic to the recipient. In some embodiments, the immunotherapy comprises a TCR-based therapy. In some embodiments, the immunotherapy comprises adjuvant immunotherapy. Adjuvant immunotherapy comprises the use of one or more agents that activate components of the innate immune system, e.g., HILTONOL® (imiquimod), which targets the TLR7 pathway. In some embodiments, the immunotherapy comprises cytokine immunotherapy. Cytokine immunotherapy comprises the use of one or more cytokines that activate components of the immune system. Examples include, but are not limited to, aldesleukin (PROLEUKIN®; interleukin-2), interferon alfa-2a (ROFERON®-A), interferon alfa-2b (INTRON®-A), and peginterferon alfa-2b (PEGINTRON®). In some embodiments, the immunotherapy comprises oncolytic virus therapy. Oncolytic virus therapy uses genetically modified viruses to replicate in and kill cancer cells, leading to the release of antigens that stimulate an immune response.

TABLE P

| Original Residue | Other Exemplary Substitutions | Conservative Substitutions |
|---|---|---|
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:

(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

One type of substitutional variant involves substituting one or more hypervariable region residues of a parent antibody (e.g. a humanized or human antibody). Generally, the resulting variant(s) selected for further study will have modifications (e.g., improvements) in certain biological properties (e.g., increased affinity, reduced immunogenicity) relative to the parent antibody and/or will have substantially retained certain biological properties of the parent antibody. An exemplary substitutional variant is an affinity matured antibody, which may be conveniently generated, e.g., using phage display-based affinity maturation techniques such as those described herein. Briefly, one or more HVR residues are mutated and the variant antibodies displayed on phage and screened for a particular biological activity (e.g. binding affinity).

Alterations (e.g., substitutions) may be made in HVRs, e.g., to improve antibody affinity. Such alterations may be made in HVR "hotspots," i.e., residues encoded by codons that undergo mutation at high frequency during the somatic maturation process (see, e.g., Chowdhury, *Methods Mol. Biol.* 207:179-196 (2008)), and/or residues that contact antigen, with the resulting variant VH or VL being tested for binding affinity. Affinity maturation by constructing and reselecting from secondary libraries has been described, e.g., in Hoogenboom et al. in *Methods in Molecular Biology* 178:1-37 (O'Brien et al., ed., Human Press, Totowa, NJ, (2001).) In some embodiments of affinity maturation, diversity is introduced into the variable genes chosen for maturation by any of a variety of methods (e.g., error-prone PCR, chain shuffling, or oligonucleotide-directed mutagenesis). A secondary library is then created. The library is then screened to identify any antibody variants with the desired affinity. Another method to introduce diversity involves HVR-directed approaches, in which several HVR residues (e.g., 4-6 residues at a time) are randomized. HVR residues involved in antigen binding may be specifically identified, e.g., using alanine scanning mutagenesis or modeling. CDR-H3 and CDR-L3 in particular are often targeted.

In certain embodiments, substitutions, insertions, or deletions may occur within one or more HVRs so long as such alterations do not substantially reduce the ability of the antibody to bind antigen. For example, conservative alterations (e.g., conservative substitutions as provided herein) that do not substantially reduce binding affinity may be made in HVRs. Such alterations may, for example, be outside of antigen contacting residues in the HVRs. In certain embodiments of the variant VH and VL sequences provided above, each HVR either is unaltered, or contains no more than one, two or three amino acid substitutions.

A useful method for identification of residues or regions of an antibody that may be targeted for mutagenesis is called "alanine scanning mutagenesis" as described by Cunningham and Wells (1989) *Science,* 244:1081-1085. In this method, a residue or group of target residues (e.g., charged residues such as arg, asp, his, lys, and glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antibody complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue. Other insertional variants of the antibody molecule include the fusion to the N- or C-terminus of the antibody to an enzyme (e.g. for ADEPT) or a polypeptide which increases the serum half-life of the antibody.

b) Glycosylation Variants

In certain embodiments, an antibody of the present disclosure is altered to increase or decrease the extent to which the antibody is glycosylated. Addition or deletion of glycosylation sites to an antibody may be conveniently accomplished by altering the amino acid sequence such that one or more glycosylation sites is created or removed.

Where the antibody comprises an Fc region, the carbohydrate attached thereto may be altered. Native antibodies produced by mammalian cells typically comprise a branched, biantennary oligosaccharide that is generally attached by an N-linkage to Asn297 of the $CH_2$ domain of the Fc region. See, e.g., Wright et al. *TIBTECH* 15:26-32 (1997). The oligosaccharide may include various carbohydrates, e.g., mannose, N-acetyl glucosamine (GlcNAc), galactose, and sialic acid, as well as a fucose attached to a GlcNAc in the "stem" of the biantennary oligosaccharide structure. In some embodiments, modifications of the oligosaccharide in an antibody of the invention may be made in order to create antibody variants with certain improved properties.

In one embodiment, antibody variants are provided having a carbohydrate structure that lacks fucose attached (directly or indirectly) to an Fc region. For example, the amount of fucose in such antibody may be from 1% to 80%, from 1% to 65%, from 5% to 65% or from 20% to 40%. The amount of fucose is determined by calculating the average amount of fucose within the sugar chain at Asn297, relative to the sum of all glycostructures attached to Asn 297 (e.g. complex, hybrid and high mannose structures) as measured by MALDI-TOF mass spectrometry, as described in WO 2008/077546, for example. Asn297 refers to the asparagine residue located at about position 297 in the Fc region (Eu numbering of Fc region residues); however, Asn297 may also be located about +3 amino acids upstream or downstream of position 297, i.e., between positions 294 and 300, due to minor sequence variations in antibodies. Such fucosylation variants may have improved ADCC function. See, e.g., US Patent Publication Nos. US2003/0157108; US2004/0093621. Examples of publications related to "defucosylated" or "fucose-deficient" antibody variants include: US 2003/0157108; WO 2000/61739; WO 2001/29246; US 2003/0115614; US 2002/0164328; US 2004/0093621; US 2004/0132140; US 2004/0110704; US 2004/0110282; US 2004/0109865; WO 2003/085119; WO 2003/084570; WO 2005/035586; WO 2005/035778; WO2005/053742; WO2002/031140; Okazaki et al. *J Mol. Biol.* 336:1239-1249 (2004); Yamane-Ohnuki et al. *Biotech. Bioeng.* 87: 614 (2004). Examples of cell lines capable of producing defucosylated antibodies include Lec13 CHO cells deficient in protein fucosylation (Ripka et al. *Arch. Biochem. Biophys.* 249:533-545 (1986); US Pat Appl No US 2003/0157108 A1, Presta, L; and WO 2004/056312 A1, Adams et al., especially at Example 11), and knockout cell lines, such as alpha-1,6-fucosyltransferase gene, FUT8, knockout CHO cells (see, e.g., Yamane-Ohnuki et al. *Biotech. Bioeng.* 87: 614 (2004); Kanda, Y. et al., *Biotechnol. Bioeng.,* 94(4):680-688 (2006); and WO2003/085107).

Antibody variants are further provided with bisected oligosaccharides, e.g., in which a biantennary oligosaccharide attached to the Fc region of the antibody is bisected by GlcNAc. Such antibody variants may have reduced fucosylation and/or improved ADCC function. Examples of such antibody variants are described, e.g., in WO 2003/011878 (Jean-Mairet et al.); U.S. Pat. No. 6,602,684 (Umana et al.); and US 2005/0123546 (Umana et al.). Antibody variants with at least one galactose residue in the oligosaccharide attached to the Fc region are also provided. Such antibody variants may have improved CDC function. Such antibody variants are described, e.g., in WO 1997/30087 (Patel et al.); WO 1998/58964 (Raju, S.); and WO 1999/22764 (Raju, S.).

c) Fc Region Variants

In certain embodiments, one or more amino acid modifications may be introduced into the Fc region of an antibody of the present disclosure, thereby generating an Fc region variant. The Fc region variant may comprise a human Fc region sequence (e.g., a human IgG1, IgG2, IgG3 or IgG4 Fc region) comprising an amino acid modification (e.g. a substitution) at one or more amino acid positions.

In certain embodiments, the present disclosure contemplates an antibody variant that possesses some but not all effector functions, which make it a desirable candidate for applications in which the half life of the antibody in vivo is important yet certain effector functions (such as complement and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the antibody lacks Fc□R binding (hence likely lacking ADCC activity), but retains FcRn binding ability. The primary cells for mediating ADCC, NK cells, express Fc□RIII only, whereas monocytes express Fc□RI, Fc□RII and Fc□RIII. FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); 5,821,337 (see Bruggemann, M. et al., *J. Exp. Med.* 166:1351-1361 (1987)). Alternatively, non-radioactive assays methods may be employed (see, for example, ACTI™ non-radioactive cytotoxicity assay for flow cytometry (CellTechnology, Inc. Mountain View, CA; and CytoTox 96® non-radioactive cytotoxicity assay (Promega, Madison, WI). Useful effector cells for such assays include peripheral blood mononuclear cells (PBMC) and Natural Killer (NK) cells. Alternatively, or additionally, ADCC activity of the molecule of interest may be assessed in vivo, e.g., in a animal model such as that disclosed in Clynes et al. *Proc. Nat'l Acad. Sci. USA* 95:652-656 (1998). C1q binding assays may also be carried out to confirm that the antibody is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, *Blood* 103:2738-2743 (2004)). FcRn binding and in vivo clearance/half life determinations can also be performed using methods known in the art (see, e.g., Petkova, S. B. et al., *Int'l. Immunol.* 18(12):1759-1769 (2006)).

Antibodies with reduced effector function include those with substitution of one or more of Fc region residues 238, 265, 269, 270, 297, 327 and 329 (U.S. Pat. No. 6,737,056). Such Fc mutants include Fc mutants with substitutions at two or more of amino acid positions 265, 269, 270, 297 and 327, including the so-called "DANA" Fc mutant with substitution of residues 265 and 297 to alanine (U.S. Pat. No. 7,332,581).

Certain antibody variants with improved or diminished binding to FcRs are described. (See, e.g., U.S. Pat. No. 6,737,056; WO 2004/056312, and Shields et al., *J. Biol. Chem.* 9(2): 6591-6604 (2001).)

In certain embodiments, an antibody variant comprises an Fc region with one or more amino acid substitutions which improve ADCC, e.g., substitutions at positions 298, 333, and/or 334 of the Fc region (EU numbering of residues).

In some embodiments, alterations are made in the Fc region that result in altered (i.e., either improved or diminished) C1q binding and/or Complement Dependent Cytotoxicity (CDC), e.g., as described in U.S. Pat. No. 6,194,551, WO 99/51642, and Idusogie et al. *J. Immunol.* 164: 4178-4184 (2000).

Antibodies with increased half lives and improved binding to the neonatal Fc receptor (FcRn), which is responsible for the transfer of maternal IgGs to the fetus (Guyer et al.,

*J. Immunol.* 117:587 (1976) and Kim et al., *J. Immunol.* 24:249 (1994)), are described in US2005/0014934A1 (Hinton et al.). Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434, e.g., substitution of Fc region residue 434 (U.S. Pat. No. 7,371,826).

See also Duncan & Winter, *Nature* 322:738-40 (1988); U.S. Pat. Nos. 5,648,260; 5,624,821; and WO 94/29351 concerning other examples of Fc region variants.

d) Cysteine Engineered Antibody Variants

In certain embodiments, it may be desirable to create cysteine engineered antibodies, e.g., "thioMAbs," in which one or more residues of an antibody are substituted with cysteine residues. In particular embodiments, the substituted residues occur at accessible sites of the antibody. By substituting those residues with cysteine, reactive thiol groups are thereby positioned at accessible sites of the antibody and may be used to conjugate the antibody to other moieties, such as drug moieties or linker-drug moieties, to create an immunoconjugate, as described further herein. In certain embodiments, any one or more of the following residues may be substituted with cysteine: V205 (Kabat numbering) of the light chain; A118 (EU numbering) of the heavy chain; and S400 (EU numbering) of the heavy chain Fc region. Cysteine engineered antibodies may be generated as described, e.g., in U.S. Pat. No. 7,521,541.

e) Antibody Derivatives

In certain embodiments, an antibody provided herein may be further modified to contain additional nonproteinaceous moieties that are known in the art and readily available. The moieties suitable for derivatization of the antibody include but are not limited to water soluble polymers. Non-limiting examples of water soluble polymers include, but are not limited to, polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), and dextran or poly(n-vinyl pyrrolidone) polyethylene glycol, propropylene glycol homopolymers, prolypropylene oxide/ethylene oxide co-polymers, polyoxyethylated polyols (e.g., glycerol), polyvinyl alcohol, and mixtures thereof. Polyethylene glycol propionaldehyde may have advantages in manufacturing due to its stability in water. The polymer may be of any molecular weight, and may be branched or unbranched. The number of polymers attached to the antibody may vary, and if more than one polymer are attached, they can be the same or different molecules. In general, the number and/or type of polymers used for derivatization can be determined based on considerations including, but not limited to, the particular properties or functions of the antibody to be improved, whether the antibody derivative will be used in a therapy under defined conditions, etc.

In another embodiment, conjugates of an antibody and nonproteinaceous moiety that may be selectively heated by exposure to radiation are provided. In one embodiment, the nonproteinaceous moiety is a carbon nanotube (Kam et al., *Proc. Natl. Acad. Sci. USA* 102: 11600-11605 (2005)). The radiation may be of any wavelength, and includes, but is not limited to, wavelengths that do not harm ordinary cells, but which heat the nonproteinaceous moiety to a temperature at which cells proximal to the antibody-nonproteinaceous moiety are killed.

Therapeutic formulations of the immune checkpoint inhibitors, e.g., PD-L1 axis binding antagonists (e.g., an anti-PD-L1 antibody (e.g., MPDL3280A)) and antagonists directed against a co-inhibitory molecule (e.g., a CTLA-4 antagonist (e.g., an anti-CTLA-4 antibody), a TIM-3 antagonist (e.g., an anti-TIM-3 antibody), or a LAG-3 antagonist (e.g., an anti-LAG-3 antibody)) used in accordance with the present invention are prepared for storage by mixing the antagonist having the desired degree of purity with optional pharmaceutically acceptable carriers, excipients, or stabilizers in the form of lyophilized formulations or aqueous solutions. For general information concerning formulations, see, e.g., Gilman et al. (eds.) The Pharmacological Bases of Therapeutics, 8th Ed., Pergamon Press, 1990; A. Gennaro (ed.), Remington's Pharmaceutical Sciences, 18th Edition, Mack Publishing Co., Pennsylvania, 1990; Avis et al. (eds.) Pharmaceutical Dosage Forms: Parenteral Medications Dekker, New York, 1993; Lieberman et al. (eds.) Pharmaceutical Dosage Forms: Tablets Dekker, New York, 1990; Lieberman et al. (eds.), Pharmaceutical Dosage Forms: Disperse Systems Dekker, New York, 1990; and Walters (ed.) Dermatological and Transdermal Formulations (Drugs and the Pharmaceutical Sciences), Vol 1 19, Marcel Dekker, 2002.

Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™, or polyethylene glycol (PEG).

The formulation herein may also contain more than one active compound, for example, those with complementary activities that do not adversely affect each other. The type and effective amounts of such medicaments depend, for example, on the amount and type of antagonist present in the formulation, and clinical parameters of the subjects.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

Sustained-release preparations may be prepared. Suitable examples of sustained-release preparations include semipermeable matrices of solid hydrophobic polymers containing the antagonist, which matrices are in the form of shaped articles, e.g., films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and y ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid.

The formulations to be used for in vivo administration must be sterile. This is readily accomplished by filtration through sterile filtration membranes.

It is to be understood that any of the above articles of manufacture may include an immunoconjugate described herein in place of or in addition to an immune checkpoint inhibitor.

Kits

In one aspect, the disclosure features, a kit, e.g., containing a reagent (e.g., an oligonucleotide) for detecting a mutation described herein, e.g., a fusion molecule described herein. In some embodiments, the oligonucleotide comprises the mutation. Optionally, the kit can also contain an oligonucleotide that is the wildtype counterpart of the mutant oligonucleotide.

A kit featured in the disclosure can include a carrier, e.g., a means being compartmentalized to receive in close confinement one or more container means. In one embodiment the container contains an oligonucleotide, e.g., a primer or probe as described above. The components of the kit are useful, for example, to diagnose or identify a mutation in a tumor sample in a patient. The probe or primer of the kit can be used in any sequencing or nucleotide detection assay known in the art, e.g., a sequencing assay, e.g., an NGS method, RT-PCR, or in situ hybridization.

In some embodiments, the components of the kit are useful, for example, to diagnose or identify a fusion molecule described herein in a tumor sample in a patient, and to accordingly identify an appropriate therapeutic agent to treat the cancer.

A kit featured in the disclosure can include, e.g., assay positive and negative controls, nucleotides, enzymes (e.g., RNA or DNA polymerase or ligase), solvents or buffers, a stabilizer, a preservative, a secondary antibody, e.g., an anti-HRP antibody (IgG) and a detection reagent.

An oligonucleotide can be provided in any form, e.g., liquid, dried, semi-dried, or lyophilized, or in a form for storage in a frozen condition.

Typically, an oligonucleotide, and other components in a kit are provided in a form that is sterile. An oligonucleotide, e.g., an oligonucleotide that contains a mutation, e.g., a fusion nucleic acid molecule described herein, or an oligonucleotide complementary to a fusion nucleic acid molecule described herein, is provided in a liquid solution, the liquid solution generally is an aqueous solution, e.g., a sterile aqueous solution. When the oligonucleotide is provided as a dried form, reconstitution generally is accomplished by the addition of a suitable solvent. The solvent, e.g., sterile buffer, can optionally be provided in the kit.

The kit can include one or more containers for the composition containing an oligonucleotide in a concentration suitable for use in the assay or with instructions for dilution for use in the assay. In some embodiments, the kit contains separate containers, dividers or compartments for the oligonucleotide and assay components, and the informational material. For example, the oligonucleotides can be contained in a bottle or vial, and the informational material can be contained in a plastic sleeve or packet. In other embodiments, the separate elements of the kit are contained within a single, undivided container. For example, an oligonucleotide composition is contained in a bottle or vial that has attached thereto the informational material in the form of a label. In some embodiments, the kit includes a plurality (e.g., a pack) of individual containers, each containing one or more unit forms (e.g., for use with one assay) of an oligonucleotide. For example, the kit includes a plurality of ampoules, foil packets, or blister packs, each containing a single unit of oligonucleotide for use in sequencing or detecting a mutation in a tumor sample. The containers of the kits can be air tight and/or waterproof. The container can be labeled for use.

For antibody-based kits, the kit can include: (1) a first antibody (e.g., attached to a solid support) which binds to a fusion polypeptide; and, optionally, (2) a second, different antibody which binds to either the polypeptide or the first antibody and is conjugated to a detectable agent.

In one embodiment, the kit can include informational material for performing and interpreting the sequencing or diagnostic. In another embodiment, the kit can provide guidance as to where to report the results of the assay, e.g., to a treatment center or healthcare provider. The kit can include forms for reporting the results of a sequencing or diagnostic assay described herein, and address and contact information regarding where to send such forms or other related information; or a URL (Uniform Resource Locator) address for reporting the results in an online database or an online application (e.g., an app). In another embodiment, the informational material can include guidance regarding whether a patient should receive treatment with a particular chemotherapeutic drug, depending on the results of the assay.

The informational material of the kits is not limited in its form. In many cases, the informational material, e.g., instructions, is provided in printed matter, e.g., a printed text, drawings, and/or photographs, e.g., a label or printed sheet. However, the informational material can also be provided in other formats, such as computer readable material, video recording, or audio recording. In another embodiment, the informational material of the kit is contact information, e.g., a physical address, email address, website, or telephone number, where a user of the kit can obtain substantive information about the sequencing or diagnostic assay and/or its use in the methods described herein. The informational material can also be provided in any combination of formats.

In some embodiments, a biological sample is provided to an assay provider, e.g., a service provider (such as a third-party facility) or a healthcare provider, who evaluates the sample in an assay and provides a read out. For example, in one embodiment, an assay provider receives a biological sample from a subject, such as a blood or tissue sample, e.g., a biopsy sample or a nucleic acid sample, and evaluates the sample using an assay described herein, e.g., a sequencing assay or in situ hybridization assay, and determines whether the sample contains a fusion molecule described herein. The assay provider, e.g., a service provider or healthcare provider, can then conclude that the subject is, or is not, a candidate for a particular drug or a particular cancer treatment regimen.

The assay provider can provide the results of the evaluation, and optionally, conclusions regarding one or more of diagnosis, prognosis, or appropriate therapy options to, for example, a healthcare provider, or patient, or an insurance company, in any suitable format, such as by mail or electronically, or through an online database. The information collected and provided by the assay provider can be stored in a database.

TABLE P

Fusion Sequences.

| Fusion | SEQUENCE | SEQ ID NO |
|---|---|---|
| | Fusion nucleotide sequences | |
| KIRREL-NTRK1 | ATGCTGAGCCTCCTCGTCTGGATCCTCACTCTCTCCGATACTTTCTCC<br>CAAGGGACCCAGACCCGCTTCAGCCAGGAGCCAGCTGACCAGACGG<br>TGGTGGCTGGACAGCGGGCCGTGCTCCCCTGTGTGCTGCTCAACTAC<br>TCTGGAATTGTGCAATGGACCAAGGACGGGCTGGCCCTGGGCATGG<br>GCCAGGGCCTCAAAGCCTGGCCACGGTACCGGGTTGTGGGCTCCGC<br>AGACGCTGGGCAGTACAACCTGGAGATCACAGATGCTGAGCTCTCT<br>GACGACGCCTCTTACGAGTGCCAGGCCACGGAGGCCGCCCTGCGCT<br>CTCGGCGGGCCAAACTCACCGTGCTCATCCCGGCCAGTGTGCAGCTG<br>CACACGGCGGTGGAGATGCACCACTGGTGCATCCCCTTCTCTGTGGA<br>TGGGCAGCCGGCACCGTCTCTGCGCTGGCTCTTCAATGGCTCCGTGC<br>TCAATGAGACCAGCTTCATCTTCACTGAGTTCCTGGAGCCGGCAGCC<br>AATGAGACCGTGCGGCACGGGTGTCTGCGCCTCAACCAGCCCACCC<br>ACGTCAACAACGGCAACTACACGCTGCTGGCTGCCAACCCCTTCGGC<br>CAGGCCTCCGCCTCCATCATGGCTGCCTTCATGGACAACCCTTTCGA<br>GTTCAACCCCGAGGACCCCATCCCTGTCTCCTTCTCGCCGGTGGACA<br>CTAACAGCACATCTGGAGACCCGGTGGAGAAGAAGGACGAAACACC<br>TTTTGGGGTCTCGGTGGCTGTGGGCCTGGCCGTCTTTGCCTGCCTCTT<br>CCTTTCTACGCTGCTCCTTGTGCTCAACAAATGTGGACGGAGAAACA<br>AGTTTGGGATCAACCGCCCGGCTGTGCTGGCTCCAGAGGATGGGCT<br>GGCCATGTCCCTGCATTTCATGACATTGGGTGGCAGCTCCCTGTCCC<br>CCACCGAGGGCAAAGGCTCTGGGCTCCAAGGCCACATCATCGAGAA<br>CCCACAATACTTCAGTGATGCCTGTGTTCACCACATCAAGCGCCGGG<br>ACATCGTGCTCAAGTGGGAGCTGGGGGAGGGCGCCTTTGGGAAGGT<br>CTTCCTTGCTGAGTGCCACAACCTCCTGCCTGAGCAGGACAAGATGC<br>TGGTGGCTGTCAAGGCACTGAAGGAGGCGTCCGAGAGTGCTCGGCA<br>GGACTTCCAGCGTGAGGCTGAGCTGCTCACCATGCTGCAGCACCAG<br>CACATCGTGCGCTTCTTCGGCGTCTGCACCGAGGGCCGCCCCCTGCT<br>CATGGTCTTTGAGTATATGCGGCACGGGGACCTCAACCGCTTCCTCC<br>GATCCCATGGACCTGATGCCAAGCTGCTGGCTGGTGGGGAGGATGT<br>GGCTCCAGGCCCCCTGGGTCTGGGGCAGCTGCTGGCCGTGGCTAGCC<br>AGGTCGCTGCGGGGATGGTGTACCTGGCGGGTCTGCATTTTGTGCAC<br>CGGGACCTGGCCACACGCAACTGTCTAGTGGGCCAGGGACTGGTGG<br>TCAAGATTGGTGATTTTGGCATGAGCAGGGATATCTACAGCACCGAC<br>TATTACCGTGTGGGAGGCCGCACCATGCTGCCCATTCGCTGGATGCC<br>GCCCGAGAGCATCCTGTACCGTAAGTTCACCACCGAGAGCGACGTG<br>TGGAGCTTCGGCGTGGTGCTCTGGGAGATCTTCACCTACGGCAAGCA<br>GCCCTGGTACCAGCTCTCCAACACGGAGGCAATCGACTGCATCACG<br>CAGGGACGTGAGTTGGAGCGGCCACGTGCCTGCCCACCAGAGGTCT<br>ACGCCATCATGCGGGGCTGCTGGCAGCGGGAGCCCCAGCAACGCCA<br>CAGCATCAAGGATGTGCACGCCCGGCTGCAAGCCCTGGCCCAGGCA<br>CCTCCTGTCTACCTGGATGTCCTGGGCTAG | 67 |
| KIRREL-NTRK1 | ATGCTGAGCCTCCTCGTCTGGATCCTCACTCTCTCCGATACTTTCTCC<br>CAAGGGACCCAGACCCGCTTCAGCCAGGAGCCAGCTGACCAGACGG<br>TGGTGGCTGGACAGCGGGCCGTGCTCCCCTGTGTGCTGCTCAACTAC<br>TCTGGAATTGTGCAATGGACCAAGGACGGGCTGGCCCTGGGCATGG<br>GCCAGGGCCTCAAAGCCTGGCCACGGTACCGGGTTGTGGGCTCCGC<br>AGACGCTGGGCAGTACAACCTGGAGATCACAGATGCTGAGCTCTCT<br>GACGACGCCTCTTACGAGTGCCAGGCCACGGAGGCCGCCCTGCGCT<br>CTCGGCGGGCCAAACTCACCGTGCTCATCCCCCCAGAGGACACCAG<br>GATTGACGGAGGCCCTGTGATTCTACTGCAGGCAGGCACCCCCCAC<br>AACCTCACATGCCGGGCCTTCAATGCGAAGCCTGCTGCCACCATCAT<br>CTGGTTCCGGGACGGGACGCAGCAGGAGGGCGCTGTGGCCAGCACG<br>GAATTGCTGAAGGATGGGAAGAGGGAGACCACCGTGAGCCAACTGC<br>TTATTAACCCCACGGACCTGGACATAGGGCGTGTCTTCACTTGCCGA<br>AGCATGAACGAAGCCATCCCTAGTGGCAAGGAGACTTCCATCGAGC<br>TGGATGTGCACCACCCTCCTACAGTGACCCTGTCCATTGAGCCACAG<br>ACGGTGCAGGAGGGTGAGCGTGTTGTCTTTACCTGCCAGGCCACAG<br>CCAACCCCGAGATCTTGGGCTACAGGTGGGCCAAAGGGGGTTTCTT<br>GATTGAAGACGCCCACGAGAGTCGCTATGAGACAAATGTGGATTAT<br>TCCTTTTTCACGGAGCCTGTGTCTTGTGAGGTTCACAACAAAGTGGG<br>AAGCACCAATGTCAGCACTTTAGTAAATGTCCACTTTGCTCCCCGGA<br>TTGTAGTTGACCCCAAACCCACAACCACAGACATTGGCTCTGATGTG<br>ACCCTTACCTGTGTCTGGGTTGGGAATCCCCCCCTCACTCTCACCTG<br>GACCAAAAAGGACTCAAATATGGTCCTGAGTAACAGCAACCAGCTG<br>CTGCTGAAGTCGGTGACTCAGGCAGACGCTGGCACCTACACCTGCC<br>GGGCCATCGTGCCTCGAATCGGAGTGGCTGAGCGGGAGGTGCCGCT<br>CTATGTGAACGGGCCCCCCATCATCTCCAGTGAGGCAGTGCAGTATG<br>CTGTGAGGGGGTGACGGTGGCAAGGTGGAGTGTTTCATTGGGAGCAC<br>ACCACCCCCAGACCGCATAGCATGGGCCTGGAAGGAGAACTTCTTG<br>GAGGTGGGGACCCTGGAACGCTATACAGTGGAGAGGACCAACTCAG<br>GCAGTGGGGTGCTATCCACGCTCACCATCAACAATGTCATGGAGGC<br>CGACTTTCAGACTCACTACAACTGCACCGCCTGGAACAGCTTCGGGC | 68 |

TABLE P-continued

| Fusion Sequences. | | |
|---|---|---|
| Fusion | SEQUENCE | SEQ ID NO |
| | CAGGCACAGCCATCATCCAGCTGGAAGAGCGAGACACTAACAGCAC<br>ATCTGGAGACCCGGTGGAGAAGAAGGACGAAACACCTTTTGGGGTC<br>TCGGTGGCTGTGGGCCTGGCCGTCTTTGCCTGCCTCTTCCTTTCTACG<br>CTGCTCCTTGTGCTCAACAAATGTGGACGGAGAAACAAGTTTGGGAT<br>CAACCGCCCGGCTGTGCTGGCTCCAGAGGATGGGCTGGCCATGTCCC<br>TGCATTTCATGACATTGGGTGGCAGCTCCCTGTCCCCCACCGAGGGC<br>AAAGGCTCTGGGCTCCAAGGCCACATCATCGAGAACCCACAATACT<br>TCAGTGATGCCTGTGTTCACCACATCAAGCGCCGGGACATCGTGCTC<br>AAGTGGGAGCTGGGGGAGGGCGCCTTTGGGAAGGTCTTCCTTGCTG<br>AGTGCCACAACCTCCTGCCTGAGCAGGACAAGATGCTGGTGGCTGT<br>CAAGGCACTGAAGGAGGCGTCCGAGAGTGCTCGGCAGGACTTCCAG<br>CGTGAGGCTGAGCTGCTCACCATGCTGCAGCACCAGCACATCGTGC<br>GCTTCTTCGGCGTCTGCACCGAGGGCCGCCCCCTGCTCATGGTCTTT<br>GAGTATATGCGGCACGGGGACCTCAACCGCTTCCTCCGATCCCATGG<br>ACCTGATGCCAAGCTGCTGGCTGGTGGGGAGGATGTGGCTCCAGGC<br>CCCCTGGGTCTGGGGCAGCTGCTGGCCGTGGCTAGCCAGGTCGCTGC<br>GGGGATGGTGTACCTGGCGGGTCTGCATTTTGTGCACCGGGACCTGG<br>CCACACGCAACTGTCTAGTGGGCCAGGGACTGGTGGTCAAGATTGG<br>TGATTTTGGCATGAGCAGGGATATCTACAGCACCGACTATTACCGTG<br>TGGGAGGCCGCACCATGCTGCCCATTCGCTGGATGCCGCCCGAGAG<br>CATCCTGTACCGTAAGTTCACCACCGAGAGCGACGTGTGGAGCTTCG<br>GCGTGGTGCTCTGGGAGATCTTCACCTACGGCAAGCAGCCCTGGTAC<br>CAGCTCTCCAACACGGAGGCAATCGACTGCATCACGCAGGGACGTG<br>AGTTGGAGCGGCCACGTGCCTGCCCACCAGAGGTCTACGCCATCAT<br>GCGGGGCTGCTGGCAGCGGGAGCCCCAGCAACGCCACAGCATCAAG<br>GATGTGCACGCCCGGCTGCAAGCCCTGGCCCAGGCACCTCCTGTCTA<br>CCTGGATGTCCTGGGCTAG | |
| CCDC88C-NTRK1 | ATGGACGTGACAGTCTCGGAGCTCCTGGAGCTCTTCCTGCAGAGCCC<br>GCTGGTGACCTGGGTGAAAACTTTTGGCCCGTTTGGAAGCGGCAGCC<br>AGGACAACCTGACTATGTACATGGATTTAGTGGACGGCATCTTTTTG<br>AACCAAATTATGCTGCAAATAGATCCCAGGCCCACAAATCAACGCA<br>TCAATAAGCACGTCAACAATGATGTGAACCTTCGCATTCAGAATTTG<br>ACCATCTTGGTGAGAAACATTAAGACCTACTACCAGGAAGTTCTCCA<br>GCAGCTGATTGTAATGAATTTGCCCAATGTTTTGATGATTGGCAGAG<br>ACCCACTGTCTGGGAAGAGCATGGAGGAAATCAAGAAGGTGCTGCT<br>GCTGGTGCTGGGCTGTGCTGTCCAGTGTGAGAGGAAAGAGGAGTTC<br>ATTGAAAGAATCAAACAGCTGGACATTGAGACCCAGGCTGGCATCG<br>TGGCCCATATCCAGGAGGTGACTCACAACCAAGAGAACGTGTTTGA<br>CCTGCAGTGGCTGGAGCTGCCCGACGTGGCTCCGGAGGAGCTGGAG<br>GCCCTGTCGAGGAGCATGGTGCTCCACCTGCGGAGGCTCATCGACC<br>AGCGGGACGAGTGCACCGAGCTGATCGTGGACCTCACTCAGGAACG<br>GGACTACCTGCAGGCACAGCATCCACCCAGCCCCATCAAGTCCTCCA<br>GCGCCGACTCCACTCCCAGCCCCACCAGCAGCCTCTCTAGCGAAGAC<br>AAGCAGCACCTGGCCGTAGAGCTGGCCGACACCAAGGCCAGGCTGC<br>GGCGCGTCAGGCAGGAGCTGGAGGATAAGACAGAGCAGCTTGTGGA<br>CACCAGACATGAGGTGGACCAGCTGGTGCTGGAACTGCAGAAAGTT<br>AAGCAGGAGAACATCCAGCTAGCGGCAGACGCCCGGTCTGCTCGTG<br>CCTATCGAGACGAGCTGGATTCCCTGCGGGAGAAGGCGAACCGCGT<br>GGAGAGGCTGGAGCTGGAGCTGACCCGCTGCAAGGAGAAGCTGCAC<br>GACGTGGACTTCTACAAGGCCCGCATGGAGGAGCTGAGAGAAGATA<br>ATATCATTTTAATTGAAACCAAGGCCATGCTGGAGGAACAGCTGACT<br>GCTGCTCGGGCCCGGGGCGATAAAGTCCATGAGCTGGAAAAGGAGA<br>ACCTGCAGCTGAAATCCAAGCTTCACGACCTGGAATTGGACCGGGA<br>CACAGATAAGAAACGAATTGAGGAGCTGCTGGAAGAAAACATGGTC<br>CTTGAGATTGCACAGAAGCAGAGCATGAACGAATCTGCCCACCTTG<br>GCTGGGAGCTGGAGCAGCTGTCCAAGAACGCAGACTTGTCAGACGG<br>CCCGGCTGTGCTGGCTCCAGAGGATGGGCTGGCCATGTCCCTGCATT<br>TCATGACATTGGGTGGCAGCTCCCTGTCCCCCACCGAGGGCAAAGG<br>CTCTGGGCTCCAAGGCCACATCATCGAGAACCCACAATACTTCAGTG<br>ATGCCTGTGTTCACCACATCAAGCGCCGGGACATCGTGCTCAAGTGG<br>GAGCTGGGGGAGGGCGCCTTTGGGAAGGTCTTCCTTGCTGAGTGCC<br>ACAACCTCCTGCCTGAGCAGGACAAGATGCTGGTGGCTGTCAAGGC<br>ACTGAAGGAGGCGTCCGAGAGTGCTCGGCAGGACTTCCAGCGTGAG<br>GCTGAGCTGCTCACCATGCTGCAGCACCAGCACATCGTGCGCTTCTT<br>CGGCGTCTGCACCGAGGGCCGCCCCCTGCTCATGGTCTTTGAGTATA<br>TGCGGCACGGGGACCTCAACCGCTTCCTCCGATCCCATGGACCTGAT<br>GCCAAGCTGCTGGCTGGTGGGGAGGATGTGGCTCCAGGCCCCCTGG<br>GTCTGGGGCAGCTGCTGGCCGTGGCTAGCCAGGTCGCTGCGGGGAT<br>GGTGTACCTGGCGGGTCTGCATTTTGTGCACCGGGACCTGGCCACAC<br>GCAACTGTCTAGTGGGCCAGGGACTGGTGGTCAAGATTGGTGATTTT<br>GGCATGAGCAGGGATATCTACAGCACCGACTATTACCGTGTGGGAG<br>GCCGCACCATGCTGCCCATTCGCTGGATGCCGCCCGAGAGCATCCTG<br>TACCGTAAGTTCACCACCGAGAGCGACGTGTGGAGCTTCGGCGTGG<br>TGCTCTGGGAGATCTTCACCTACGGCAAGCAGCCCTGGTACCAGCTC | 69 |

TABLE P-continued

Fusion Sequences.

| Fusion | SEQUENCE | SEQ ID NO |
|---|---|---|
| | TCCAACACGGAGGCAATCGACTGCATCACGCAGGGACGTGAGTTGG<br>AGCGGCCACGTGCCTGCCCACCAGAGGTCTACGCCATCATGCGGGG<br>CTGCTGGCAGCGGGAGCCCCAGCAACGCCACAGCATCAAGGATGTG<br>CACGCCCGGCTGCAAGCCCTGGCCCAGGCACCTCCTGTCTACCTGGA<br>TGTCCTGGGCTAG | |
| DCTN1-<br>NTRK1 | ATGGCACAGAGCAAGAGGCACGTGTACAGCCGGACGCCCAGCGGCA<br>GCAGGATGAGTGCGGAGGCAAGCGCCCGGCCTCTGCGGGTGGGCTC<br>CCGTGTAGAGGTGATTGGAAAAGGCCACCGAGGCACTGTGGCCTAT<br>GTTGGAGCCACACTGTTTGCCACTGGCAAATGGGTAGGCGTGATTCT<br>GGATGAAGCAAAGGGCAAAAATGATGGAACTGTTCAAGGCAGGAA<br>GTACTTCACTTGTGATGAAGGGCATGGCATCTTTGTGCGCCAGTCCC<br>AGATCCAGGTATTTGAAGATGGAGCAGATACTACTTCCCCAGAGAC<br>ACCTGATTCTTCTGCTTCAAAAGTCCTCAAAAGAGAGGGAACTGATA<br>CAACTGCAAAGACTAGCAAACTGCGGGGACTGAAGCCTAAGAAGGC<br>ACCGACAGCCCGAAAGACCACAACTCGGCGACCCAAGCCCACGCGC<br>CCAGCCAGTACTGGGGTGGCTGGGGCCAGTAGCTCCCTGGGCCCCTC<br>TGGCTCAGCGTCAGCAGGTGAGCTGAGCAGCAGTGAGCCCAGCACC<br>CCGGCTCAGACTCCGCTGGCAGCACCCATCATCCCCACGCCGGTCCT<br>CACCTCTCCTGGAGCAGTCCCCCCGCTTCCTTCCCCATCCAAGGAGG<br>AGGAGGGACTAAGGGCTCAGGTGCGGGACCTGGAGGAGAAACTAG<br>AGACCCTGAGACTGAAACGGGCAGAAGACAAAGCAAAGCTAAAAG<br>AGCTGGAGAAACACAAAATCCAGCTGGAGCAGGTGCAGGAATGGA<br>AGAGCAAAATGCAGGAGCAGCAGGCCGACCTGCAGCGGCGCCTCAA<br>GGAGGCGAGAAAGGAAGCCAAGGAGGCGCTGGAGGCAAAGGAACG<br>CTATATGGAGGAGATGGCTGATACTGCTGATGCCATTGAGATGGCC<br>ACTTTGGACAAGGAGATGGCTGAAGAGCGGGCTGAGTCCCTGCAGC<br>AGGAGGTGGAGGCACTGAAGGAGCGGGTGGACGAGCTCACTACTGA<br>CTTAGAGATCCTCAAGGCTGAGATTGAAGAGAAGGGCTCAGATGGC<br>GCTGCATCCAGTTATCAGCTCAAGCAGCTTGAGGAGCAGAATGCCC<br>GCCTGAAGGATGCCCTGGTGAGGATGCGGGATCTTTCTTCCTCAGAG<br>AAGCAGGAGCATGTGAAGCTCCAGAAGCTCATGGAAAAGAAGAAC<br>CAAGAGCTGGAAGTTGTGAGGCAACAGCGGGAGCGTCTGCAGGAGG<br>AGCTAAGCCAGGCAGAGAGCACCATTGATGAGCTCAAGGAGCAGGT<br>GGATGCTGCTCTGGGTGCTGAGGAGATGGTGGAGATGCTGACAGAT<br>CGGAACCTGAATCTGGAAGAGAAAGTGCGCGAGTTGAGGGAGACTG<br>TGGGAGACTTGGAAGCGATGAATGAGATGAACGATGAGCTGCAGGA<br>GAATGCACGTGAGACAGAACTGGAGCTGCGGGAGCAGCTGGACATG<br>GCAGGCGCGCGGGTTCGTGAGGCCCAGAAGCGTGTGGAGGCAGCCC<br>AGGAGACGGTTGCAGACTACCAGCAGACCATCAAGAAGTACCGCCA<br>GCTGACCGCCCATCTACAGGATGTGAATCGGGAACTGACAAACCAG<br>CAGGAAGCATCTGTGGAGAGGCAACAGCAGCCACCTCCAGAGACCT<br>TTGACTTCAAAATCAAGTTTGCTGAGACTAAGGCCCATGCCAAGGCA<br>ATTGAGATGGAATTGAGGCAGATGGAGGTGGCCCAGGCCAATCGAC<br>ACATGTCCCTGCTGACAGCCTTCATGCCTGACAGCTTCCTTCGGCCA<br>GGTGGGGACCATGACTGCGTTCTGGTGCTGTTGCTCATGCCTCGTCT<br>CATTTGCAAGGCAGAGCTGATCCGGAAGCAGGCCCAGGAGAAGTTT<br>GAACTAAGTGAGAACTGTTCAGAGCGGCCTGGGCTGCGAGGAGCTG<br>CTGGGGAGCAACTCAGCTTTGCTGCTGGACTGGTGTACTCGCTGAGC<br>CTGCTGCAGGCCACGCTACACCGCTATGAGCATGCCCTCTCTCAGTG<br>CAGTGTGGATGTGTATAAGAAAGTGGGCAGCCTGTACCCTGAGATG<br>AGTGCCCATGAGCGCTCCTTGGATTTCCTCATTGAACTGCTGCACAA<br>GGATCAGCTGGATGAGACTGTCAATGTGGAGCCTCTCACCAAGGCC<br>ATCAAGTACTATCAGCATCTGTACAGCATCCACCTTGCCGAACAGCC<br>TGAGGACTGTACTATGCAGCTGGCTGACCACATTAAGTTCACGCAGA<br>GTGCTCTGGACTGCATGAGTGTGGAGGTAGGACGGCTGCGTGCCTTC<br>TTGCAGGGTGGGCAGGAGGCTACAGATATTGCCCTCCTGCTCCGGG<br>ATCTGGAAACTTCATGCAGTGACATCCGCCAGTTCTGCAAGAAGATC<br>CGAAGGCGAATGCCAGGGACAGATGCTCCTGGGATCCCAGCTGCAC<br>TGGCCTTTGGACCACAGGTATCTGACACGCTCCTAGACTGCAGGAAA<br>CACTTGACGTGGGTCGTGGCTGTGCTGCAGGAGGTGGCAGCTGCTGC<br>TGCCCAGCTCATTGCCCCACTGGCAGAGAATGAGGGGCTACTTGTGG<br>CTGCTCTGGAGGAACTGGCTTTCAAAGCAAGCGAGCAGATCTATGG<br>GACCCCCTCCAGCAGCCCCTATGAGTGTCTGCGCCAGTCATGCAACA<br>TCCTCATCAGTACCATGAACAAGCTGGCCACAGCCATGCAGGAGGG<br>GGAGTATGATGCAGAGCGGCCCCCCAGCAAGCCTCCACCGGTTGAA<br>CTGCGGGCTGCTGCCCTTCGTGCAGAGATCACAGATGCTGAAGGCCT<br>GGGTTTGAAGCTCGAAGATCGAGAGACAGTTATTAAGGAGTTGAAG<br>AAGTCACTCAAGATTAAGGGAGAGGAGCTAAGTGAGGCCAATGTGC<br>GGCTGAGCCTCCTGGAGAAGAAGTTGGACAGTGCTGCCAAGGATGC<br>AGATGAGCGCATCGAGAAAGTCCAGACTCGGCTGGAGGAGACCCAG<br>GCACTGCTGCGAAAGAAGGAGAAAGAGTTTGAGGAGACAATGGAT<br>GCACTCCAGGCTGACATCGACCAGCTGGAGGCAGAGAAGGCAGAAC<br>TAAAGCAGCGTCTGAACAGCCAGTCCAAACGCACGATTGAGGGACT<br>CCGGGGCCCTCCTCCTTCAGGCATTGCTACTCTGGTCTCTGGCATTGC | 70 |

TABLE P-continued

Fusion Sequences.

| Fusion | SEQUENCE | SEQ ID NO |
|---|---|---|
| | TGGTGGCCCGGCTGTGCTGGCTCCAGAGGATGGGCTGGCCATGTCCC<br>TGCATTTCATGACATTGGGTGGCAGCTCCCTGTCCCCCACCGAGGGC<br>AAAGGCTCTGGGCTCCAAGGCCACATCATCGAGAACCCCACAATACT<br>TCAGTGATGCCTGTGTTCACCACATCAAGCGCCGGGACATCGTGCTC<br>AAGTGGGAGCTGGGGGAGGGCGCCTTTGGGAAGGTCTTCCTTGCTG<br>AGTGCCACAACCTCCTGCCTGAGCAGGACAAGATGCTGGTGGCTGT<br>CAAGGCACTGAAGGAGGCGTCCGAGAGTGCTCGGCAGGACTTCCAG<br>CGTGAGGCTGAGCTGCTCACCATGCTGCAGCACCAGCACATCGTGC<br>GCTTCTTCGGCGTCTGCACCGAGGGCCGCCCCCTGCTCATGGTCTTT<br>GAGTATATGCGGCACGGGGACCTCAACCGCTTCCTCCGATCCCATGG<br>ACCTGATGCCAAGCTGCTGGCTGGTGGGGAGGATGTGGCTCCAGGC<br>CCCCTGGGTCTGGGGCAGCTGCTGGCCGTGGCTAGCCAGGTCGCTGC<br>GGGGATGGTGTACCTGGCGGGTCTGCATTTTGTGCACCGGGACCTGG<br>CCACACGCAACTGTCTAGTGGGCCAGGGACTGGTGGTCAAGATTGG<br>TGATTTTGGCATGAGCAGGGATATCTACAGCACCGACTATTACCGTG<br>TGGGAGGCCGCACCATGCTGCCCATTCGCTGGATGCCGCCCGAGAG<br>CATCCTGTACCGTAAGTTCACCACCGAGAGCGACGTGTGGAGCTTCG<br>GCGTGGTGCTCTGGGAGATCTTCACCTACGGCAAGCAGCCCTGGTAC<br>CAGCTCTCCAACACGGAGGCAATCGACTGCATCACGCAGGGACGTG<br>AGTTGGAGCGGCCACGTGCCTGCCCACCAGAGGTCTACGCCATCAT<br>GCGGGGCTGCTGGCAGCGGGAGCCCCAGCAACGCCACAGCATCAAG<br>GATGTGCACGCCCGGCTGCAAGCCCTGGCCCAGGCACCTCCTGTCTA<br>CCTGGATGTCCTGGGCTAG | |
| EML4-NTRK1 | ATGGACGGTTTCGCCGGCAGTCTCGATGATAGTATTTCTGCTGCAAG<br>TACTTCTGATGTTCAAGATCGCCTGTCAGCTCTTGAGTCACGAGTTC<br>AGCAACAAGAAGATGAAATCACTGTGCTAAAGGCGGCTTTGGCTGA<br>TGTTTTGAGGCGTCTTGCAATCTCTGAAGATCATGTGGCCTCAGTGA<br>AAAAATCAGTCTCAAGTAAAGGCCAACCAAGCCCTCGAGCAGTTAT<br>TCCCATGTCCTGTATAACCAATGGAAGTGGTGCAAACAGAAAACCA<br>AGTCATACCAGTGCTGTCTCAATTGCAGGAAAAGAAACTCTTTCATC<br>TGCTGCTAAAAGTGGTACAGAAAAAAAGAAAGAAAAACCACAAGG<br>ACAGAGAGAAAAAAAAGAGGAATCTCATTCTAATGATCAAAGTCCA<br>CAAATTCGAGCATCACCTTCTCCCCAGCCCTCTTCACAACCTCTCCA<br>AATACACAGACAAACTCCAGAAAGCAAGAATGCTACTCCCACCAAA<br>AGCATAAAACGACCATCACCAGCTGAAAAGTCACATAATTCTTGGG<br>AAAATTCAGATGATAGCCGTAATAAATTGTCGAAAATACCTTCAAC<br>ACCCAAATTAATACCAAAAGTTACCAAAACTGCAGACAAGCATAAA<br>GATGTCATCATCAACCAAGAAGGAGAATATATTAAAATGTTTATGC<br>GCGGTCGGCCAATTACCATGTTCATTCCTTCCGATGTTGACAACTAT<br>GATGACATCAGAACGGAACTGCCTCCTGAGAAGCTCAAACTGGAGT<br>GGGCATATGGTTATCGAGGAAAGGACTGTAGAGCTAATGTTTACCTT<br>CTTCCGACCGGGAAAATAGTTTATTTCATTGCATCAGTAGTAGTACT<br>ATTTAATTATGAGGAGAGAACTCAGCGACACTACCTGGGCCATACA<br>GACTGTGTGAAATGCCTTGCTATACATCCTGACAAAATTAGGATTGC<br>AACTGGACAGATAGCTGGCGTGGATAAAGATGGAAGGCCTCTACAA<br>CCCCACGTCAGAGTGTGGGATTCTGTTACTCTATCCACACTGCAGAT<br>TATTGGACTTGGCACTTTTGAGCGTGGAGTAGGATGCCTGGATTTTT<br>CAAAAGCAGATTCAGGTGTTCATTTATGTATTATTGATGACTCCAAT<br>GAGCATATGCTTACTGTATGGGACTGGCAGAAGAAAGCAAAAGGAG<br>CAGAAATAAAGACAACAAATGAAGTTGTTTTGGCTGTGGAGTTTCA<br>CCCAACAGATGCAAATACCATAATTACATGCGGTAAATCTCATATTT<br>TCTTCTGGACCTGGAGCGGCAATTCACTAACAAGAAAACAGGGAAT<br>TTTTGGGAAATATGAAAAGCCAAAATTTGTGCAGTGTTTAGCATTCT<br>TGGGGAATGGAGATGTTCTTACTGGAGACTCAGGTGGAGTCATGCTT<br>ATATGGAGCAAAACTACTGTAGAGCCCACACCTGGGAAAGGACCTA<br>AAGGTGTATATCAAATCAGCAAACAAATCAAAGCTCATGATGGCAG<br>TGTGTTCACACTTTGTCAGATGAGAAATGGGATGTTATTAACTGGAG<br>GAGGGAAAGACAGAAAAATAATTCTGTGGGATCATGATCTGAATCC<br>TGAAAGAGAAATAGAGGTTCCTGATCAGTATGGCACAATCAGAGCT<br>GTAGCAGAAGGAAAGGCAGATCAATTTTTAGTAGGCACATCACGAA<br>ACTTTATTTTACGAGGAACATTTAATGATGGCTTCCAAATAGAAGTA<br>CAGGGTCATACAGATGAGCTTTGGGGTCTTGCCACACATCCCTTCAA<br>AGATTTGCTCTTGACATGTGCTCAGGACAGGCAGGTGTGCCTGTGGA<br>ACTCAATGGAACACAGGCTGGAATGGACCAGGCTGGTAGATGAACC<br>AGGACACTGTGCAGATTTTCATCCAAGTGGCACAGTGGTGGCCATA<br>GGAACGCACTCAGGCAGGTGGTTTGTTCTGGATGCAGAAACCAGAG<br>ATCTAGTTTCTATCCACACAGACGGGAATGAACAGCTCTCTGTGATG<br>CGCTACTCAATAGGCCCGGCTGTGCTGGCTCCAGAGGATGGGCTGG<br>CCATGTCCCTGCATTTCATGACATTGGGTGGCAGCTCCCTGTCCCCC<br>ACCGAGGGCAAAGGCTCTGGGCTCCAAGGCCACATCATCGAGAACC<br>CACAATACTTCAGTGATGCCTGTGTTCACCACATCAAGCGCCGGGAC<br>ATCGTGCTCAAGTGGGAGCTGGGGGAGGGCGCCTTTGGGAAGGTCT<br>TCCTTGCTGAGTGCCACAACCTCCTGCCTGAGCAGGACAAGATGCTG<br>GTGGCTGTCAAGGCACTGAAGGAGGCGTCCGAGAGTGCTCGGCAGG | 71 |

TABLE P-continued

| Fusion Sequences. | | |
|---|---|---|
| Fusion | SEQUENCE | SEQ ID NO |
| | ACTTCCAGCGTGAGGCTGAGCTGCTCACCATGCTGCAGCACCAGCAC ATCGTGCGCTTCTTCGGCGTCTGCACCGAGGGCCGCCCCCTGCTCAT GGTCTTTGAGTATATGCGGCACGGGGACCTCAACCGCTTCCTCCGAT CCCATGGACCTGATGCCAAGCTGCTGGCTGGTGGGGAGGATGTGGC TCCAGGCCCCCTGGGTCTGGGGCAGCTGCTGGCCGTGGCTAGCCAG GTCGCTGCGGGGATGGTGTACCTGGCGGGTCTGCATTTTGTGCACCG GGACCTGGCCACACGCAACTGTCTAGTGGGCCAGGGACTGGTGGTC AAGATTGGTGATTTTGGCATGAGCAGGGATATCTACAGCACCGACT ATTACCGTGTGGGAGGCCGCACCATGCTGCCCATTCGCTGGATGCCG CCCGAGAGCATCCTGTACCGTAAGTTCACCACCGAGAGCGACGTGT GGAGCTTCGGCGTGGTGCTCTGGGAGATCTTCACCTACGGCAAGCA GCCCTGGTACCAGCTCTCCAACACGGAGGCAATCGACTGCATCACG CAGGGACGTGAGTTGGAGCGGCCACGTGCCTGCCCACCAGAGGTCT ACGCCATCATGCGGGGCTGCTGGCAGCGGGAGCCCCAGCAACGCCA CAGCATCAAGGATGTGCACGCCCGGCTGCAAGCCCTGGCCCAGGCA CCTCCTGTCTACCTGGATGTCCTGGGCTAG | |
| PRKAR1A-NTRK1 | ATGGAGTCTGGCAGTACCGCCGCCAGTGAGGAGGCACGCAGCCTTC GAGAATGTGAGCTCTACGTCCAGAAGCATAACATTCAAGCGCTGCT CAAAGATTCTATTGTGCAGTTGTGCACTGCTCGACCTGAGAGACCCA TGGCATTCCTCAGGGAATACTTTGAGAGGTTGGAGAAGGAGGAGGC AAAACAGATTCAGAATCTGCAGAAAGCAGGCACTCGTACAGACTCA AGGGAGGATGAGATTTCTCCTCCTCCACCCAACCCAGTGGTTAAAGG TAGGAGGCGACGAGGTGCTATCAGCGCTGAGGTCTACACGGAGGAA GATGCGGCATCCTATGTTAGAAAGGTTATACCAAAAGATTACAAGA CAATGGCCGCTTTAGCCAAAGCCATTGAAAAGAATGTGCTGTTTTCA CATCTTGATGATAATGAGAGAAGTGATATTTTTGATGCCATGTTTTC GGTCTCCTTTATCGCAGGAGAGACTGTGATTCAGCAAGGTGATGAA GGGGATAACTTCTATGTGATTGATCAAGGAGAGACGGATGTCTATGT TAACAATGAATGGGCAACCAGTGTTGGGGAAGGAGGGAGCTTTGGA GAACTTGCTTTGATTTATGGAACACCGAGAGCAGCCACTGTCAAAGC AAAGACAAATGTGAAATTGTGGGGCATCGACCGAGACAGCTATAGA AGAATCCTCATGGGAAGCACACTGAGAAAGCGGAAGATGTATGAGG AATTCCTTAGTAAAGTCTCTATTTTAGGCCCGGCTGTGCTGGCTCCA GAGGATGGGCTGGCCATGTCCCTGCATTTCATGACATTGGGTGGCAG CTCCCTGTCCCCCACCGAGGGCAAAGGCTCTGGGCTCCAAGGCCAC ATCATCGAGAACCCACAATACTTCAGTGATGCCTGTGTTCACCACAT CAAGCGCCGGGACATCGTGCTCAAGTGGGAGCTGGGGGAGGGCGCC TTTGGGAAGGTCTTCCTTGCTGAGTGCCACAACCTCCTGCCTGAGCA GGACAAGATGCTGGTGGCTGTCAAGGCACTGAAGGAGGCGTCCGAG AGTGCTCGGCAGGACTTCCAGCGTGAGGCTGAGCTGCTCACCATGCT GCAGCACCAGCACATCGTGCGCTTCTTCGGCGTCTGCACCGAGGGCC GCCCCCTGCTCATGGTCTTTGAGTATATGCGGCACGGGGACCTCAAC CGCTTCCTCCGATCCCATGGACCTGATGCCAAGCTGCTGGCTGGTGG GGAGGATGTGGCTCCAGGCCCCCTGGGTCTGGGGCAGCTGCTGGCC GTGGCTAGCCAGGTCGCTGCGGGGATGGTGTACCTGGCGGGTCTGC ATTTTGTGCACCGGGACCTGGCCACACGCAACTGTCTAGTGGGCCAG GGACTGGTGGTCAAGATTGGTGATTTTGGCATGAGCAGGGATATCTA CAGCACCGACTATTACCGTGTGGGAGGCCGCACCATGCTGCCCATTC GCTGGATGCCGCCCGAGAGCATCCTGTACCGTAAGTTCACCACCGA GAGCGACGTGTGGAGCTTCGGCGTGGTGCTCTGGGAGATCTTCACCT ACGGCAAGCAGCCCTGGTACCAGCTCTCCAACACGGAGGCAATCGA CTGCATCACGCAGGGACGTGAGTTGGAGCGGCCACGTGCCTGCCCA CCAGAGGTCTACGCCATCATGCGGGGCTGCTGGCAGCGGGAGCCCC AGCAACGCCACAGCATCAAGGATGTGCACGCCCGGCTGCAAGCCCT GGCCCAGGCACCTCCTGTCTACCTGGATGTCCTGGGCTAG | 72 |
| PTPRC-NTRK1 | ATGACCATGTATTTGTGGCTTAAACTCTTGGCATTTGGCTTTGCCTTT CTGGACACAGAAGTATTTGTGACAGTCCCGGCCAGTGTGCAGCTGC ACACGGCGGTGGAGATGCACCACTGGTGCATCCCCTTCTCTGTGGAT GGGCAGCCGGCACCGTCTCTGCGCTGGCTCTTCAATGGCTCCGTGCT CAATGAGACCAGCTTCATCTTCACTGAGTTCCTGGAGCCGGCAGCCA ATGAGACCGTGCGGCACGGGTGTCTGCGCCTCAACCAGCCCACCCA CGTCAACAACGGCAACTACACGCTGCTGGCTGCCAACCCCTTCGGCC AGGCCTCCGCCTCCATCATGGCTGCCTTCATGGACAACCCTTTCGAG TTCAACCCCGAGGACCCCATCCCTGTCTCCTTCTCGCCGGTGGACAC TAACAGCACATCTGGAGACCCGGTGGAGAAGAAGGACGAAACACCT TTTGGGGTCTCGGTGGCTGTGGGCCTGGCCGTCTTTGCCTGCCTCTTC CTTTCTACGCTGCTCCTTGTGCTCAACAAATGTGGACGGAGAAACAA GTTTGGGATCAACCGCCCGGCTGTGCTGGCTCCAGAGGATGGGCTG GCCATGTCCCTGCATTTCATGACATTGGGTGGCAGCTCCCTGTCCCC CACCGAGGGCAAAGGCTCTGGGCTCCAAGGCCACATCATCGAGAAC CCACAATACTTCAGTGATGCCTGTGTTCACCACATCAAGCGCCGGGA CATCGTGCTCAAGTGGGAGCTGGGGGAGGGCGCCTTTGGGAAGGTC TTCCTTGCTGAGTGCCACAACCTCCTGCCTGAGCAGGACAAGATGCT | 73 |

TABLE P-continued

Fusion Sequences.

| Fusion | SEQUENCE | SEQ ID NO |
|---|---|---|
| | GGTGGCTGTCAAGGCACTGAAGGAGGCGTCCGAGAGTGCTCGGCAG<br>GACTTCCAGCGTGAGGCTGAGCTGCTCACCATGCTGCAGCACCAGC<br>ACATCGTGCGCTTCTTCGGCGTCTGCACCGAGGGCCGCCCCCTGCTC<br>ATGGTCTTTGAGTATATGCGGCACGGGGACCTCAACCGCTTCCTCCG<br>ATCCCATGGACCTGATGCCAAGCTGCTGGCTGGTGGGGAGGATGTG<br>GCTCCAGGCCCCCTGGGTCTGGGGCAGCTGCTGGCCGTGGCTAGCCA<br>GGTCGCTGCGGGGATGGTGTACCTGGCGGGTCTGCATTTTGTGCACC<br>GGGACCTGGCCACACGCAACTGTCTAGTGGGCCAGGGACTGGTGGT<br>CAAGATTGGTGATTTTGGCATGAGCAGGGATATCTACAGCACCGACT<br>ATTACCGTGTGGGAGGCCGCACCATGCTGCCCATTCGCTGGATGCCG<br>CCCGAGAGCATCCTGTACCGTAAGTTCACCACCGAGAGCGACGTGT<br>GGAGCTTCGGCGTGGTGCTCTGGGAGATCTTCACCTACGGCAAGCA<br>GCCCTGGTACCAGCTCTCCAACACGGAGGCAATCGACTGCATCACG<br>CAGGGACGTGAGTTGGAGCGGCCACGTGCCTGCCCACCAGAGGTCT<br>ACGCCATCATGCGGGGCTGCTGGCAGCGGGAGCCCCAGCAACGCCA<br>CAGCATCAAGGATGTGCACGCCCGGCTGCAAGCCCTGGCCCAGGCA<br>CCTCCTGTCTACCTGGATGTCCTGGGCTAG | |
| ARGLU1<br>NTRK1- | ATGGGCCGGTCTCGGAGCCGGAGCTCGTCCCGCTCCAAGCACACCA<br>AGAGCAGCAAGCACAACAAGAAGCGCAGCCGGTCCCGGTCGCGATC<br>CCGGGACAAGGAGCGCGTGCGGAAGCGTTCCAAATCTCGGGAAAGT<br>AAACGGAACCGGCGGCGGGAGTCGCGGTCCCGTTCGCGCTCCACCA<br>ACACGGCCGTGTCCCGGCGCGAGCGGGACCGGGAGCGCGCCTCGTC<br>CCCGCCCGACCGCATCGACATCTTCGGGCGCACGGTGAGCAAGCGC<br>AGCAGCCTGGACGAGAAGCAGAAGCGAGAGGAGGAGGAGAAGAAA<br>GCGGAGTTCGAGCGGCAGCGAAAAATTCGACAGCAAGAAATAGAA<br>GAAAAACTCATCGAGGAAGAAACAGCACGAAGAGTAGAAGAATTG<br>GTAGCAAAAAGGGTGGAGGAAGAACTGGAGAAAAGGAAGGATGAA<br>ATTGAACGAGAAGTTCTCCGAAGGGTGGAGGAAGCCAAACGCATCA<br>TGGAAAAGCAGTTGCTCGAAGAACTCGAGCGACAGAGACAAGCTGA<br>GCTTGCCGCACAAAAAGCTAGAGAGGAGGAAGAACGTGCAAAACG<br>TGAGGAGCTAGAGCGAATACTGGAAGAGAATAACCGAAAAATTGCA<br>GAAGCACAAGCCAAACTGGTCTCGGTGGCTGTGGGCCTGGCCGTCTT<br>TGCCTGCCTCTTCCTTTCTACGCTGCTCCTTGTGCTCAACAAATGTGG<br>ACGGAGAAACAAGTTTGGGATCAACCGCCCGGCTGTGCTGGCTCCA<br>GAGGATGGGCTGGCCATGTCCCTGCATTTCATGACATTGGGTGGCAG<br>CTCCCTGTCCCCCACCGAGGGCAAAGGCTCTGGGCTCCAAGGCCAC<br>ATCATCGAGAACCCACAATACTTCAGTGATGCCTGTGTTCACCACAT<br>CAAGCGCCGGGACATCGTGCTCAAGTGGGAGCTGGGGGAGGGCGCC<br>TTTGGGAAGGTCTTCCTTGCTGAGTGCCACAACCTCCTGCCTGAGCA<br>GGACAAGATGCTGGTGGCTGTCAAGGCACTGAAGGAGGCGTCCGAG<br>AGTGCTCGGCAGGACTTCCAGCGTGAGGCTGAGCTGCTCACCATGCT<br>GCAGCACCAGCACATCGTGCGCTTCTTCGGCGTCTGCACCGAGGGCC<br>GCCCCCTGCTCATGGTCTTTGAGTATATGCGGCACGGGGACCTCAAC<br>CGCTTCCTCCGATCCCATGGACCTGATGCCAAGCTGCTGGCTGGTGG<br>GGAGGATGTGGCTCCAGGCCCCCTGGGTCTGGGGCAGCTGCTGGCC<br>GTGGCTAGCCAGGTCGCTGCGGGGATGGTGTACCTGGCGGGTCTGC<br>ATTTTGTGCACCGGGACCTGGCCACACGCAACTGTCTAGTGGGCCAG<br>GGACTGGTGGTCAAGATTGGTGATTTTGGCATGAGCAGGGATATCTA<br>CAGCACCGACTATTACCGTGTGGGAGGCCGCACCATGCTGCCCATTC<br>GCTGGATGCCGCCCGAGAGCATCCTGTACCGTAAGTTCACCACCGA<br>GAGCGACGTGTGGAGCTTCGGCGTGGTGCTCTGGGAGATCTTCACCT<br>ACGGCAAGCAGCCCTGGTACCAGCTCTCCAACACGGAGGCAATCGA<br>CTGCATCACGCAGGGACGTGAGTTGGAGCGGCCACGTGCCTGCCCA<br>CCAGAGGTCTACGCCATCATGCGGGGCTGCTGGCAGCGGGAGCCCC<br>AGCAACGCCACAGCATCAAGGATGTGCACGCCCGGCTGCAAGCCCT<br>GGCCCAGGCACCTCCTGTCTACCTGGATGTCCTGGGCTAG | 74 |
| MEX3A-<br>NTRK1 | ATGCCTAGTCTAGTGGTATCTGGAATAATGGAAAGAAATGGGGGCT<br>TTGGAGAACTAGGATGTTTCGGGGGAAGCGCTAAGGACCGAGGGCT<br>GCTGGAAGACGAGCGCGCCCTTCAGCTGGCTCTCGATCAACTCTGCC<br>TCCTGGGTTTGGGGGAGCCCCCCGCCCCCACGGCGGGCGAGGACGG<br>GGGAGGTGGGGGGGGCGGCGCCCCCGCGCAGCCGGCCGCCCCCCCG<br>CAGCCGGCCCCGCCGCCGCCGCCCGCGGCGCCCCCGGCCGCCCCGA<br>CGGCGGCCCCCGCAGCGCAGACGCCCCAGCCCCCCACCGCCCCCAA<br>AGGGGCGAGCGACGCCAAGCTCTGCGCTCTCTACAAAGAGGCCGAG<br>CTGCGCCTGAAGGGCAGCAGCAACACCACGGAGTGTGTTCCCGTGC<br>CCACCTCCGAGCACGTGGCCGAGATCGTGGGCAGGCAAGTCTCCTTC<br>TCGCCGGTGGACACTAACAGCACATCTGGAGACCCGGTGGAGAAGA<br>AGGACGAAACACCTTTTGGGGTCTCGGTGGCTGTGGGCCTGGCCGTC<br>TTTGCCTGCCTCTTCCTTTCTACGCTGCTCCTTGTGCTCAACAAATGT<br>GGACGGAGAAACAAGTTTGGGATCAACCGCCCGGCTGTGCTGGCTC<br>CAGAGGATGGGCTGGCCATGTCCCTGCATTTCATGACATTGGGTGGC<br>AGCTCCCTGTCCCCCACCGAGGGCAAAGGCTCTGGGCTCCAAGGCC<br>ACATCATCGAGAACCCACAATACTTCAGTGATGCCTGTGTTCACCAC | 75 |

TABLE P-continued

Fusion Sequences.

| Fusion | SEQUENCE | SEQ ID NO |
|---|---|---|
| | ATCAAGCGCCGGGACATCGTGCTCAAGTGGGAGCTGGGGGAGGGCG<br>CCTTTGGGAAGGTCTTCCTTGCTGAGTGCCACAACCTCCTGCCTGAG<br>CAGGACAAGATGCTGGTGGCTGTCAAGGCACTGAAGGAGGCGTCCG<br>AGAGTGCTCGGCAGGACTTCCAGCGTGAGGCTGAGCTGCTCACCAT<br>GCTGCAGCACCAGCACATCGTGCGCTTCTTCGGCGTCTGCACCGAGG<br>GCCGCCCCCTGCTCATGGTCTTTGAGTATATGCGGCACGGGGACCTC<br>AACCGCTTCCTCCGATCCCATGGACCTGATGCCAAGCTGCTGGCTGG<br>TGGGGAGGATGTGGCTCCAGGCCCCCTGGGTCTGGGGCAGCTGCTG<br>GCCGTGGCTAGCCAGGTCGCTGCGGGGATGGTGTACCTGGCGGGTC<br>TGCATTTTGTGCACCGGGACCTGGCCACACGCAACTGTCTAGTGGGC<br>CAGGGACTGGTGGTCAAGATTGGTGATTTTGGCATGAGCAGGGATA<br>TCTACAGCACCGACTATTACCGTGTGGGAGGCCGCACCATGCTGCCC<br>ATTCGCTGGATGCCGCCCGAGAGCATCCTGTACCGTAAGTTCACCAC<br>CGAGAGCGACGTGTGGAGCTTCGGCGTGGTGCTCTGGGAGATCTTC<br>ACCTACGGCAAGCAGCCCTGGTACCAGCTCTCCAACACGGAGGCAA<br>TCGACTGCATCACGCAGGGACGTGAGTTGGAGCGGCCACGTGCCTG<br>CCCACCAGAGGTCTACGCCATCATGCGGGGCTGCTGGCAGCGGGAG<br>CCCCAGCAACGCCACAGCATCAAGGATGTGCACGCCCGGCTGCAAG<br>CCCTGGCCCAGGCACCTCCTGTCTACCTGGATGTCCTGGGCTAG | |
| SEL1L-<br>NTRK1 | ATGCGGGTCCGGATAGGGCTGACGCTGCTGCTGTGTGCGGTGCTGCT<br>GAGCTTGGCCTCGGCGTCCTCGGTCCCGGCCAGTGTGCAGCTGCACA<br>CGGCGGTGGAGATGCACCACTGGTGCATCCCCTTCTCTGTGGATGGG<br>CAGCCGGCACCGTCTCTGCGCTGGCTCTTCAATGGCTCCGTGCTCAA<br>TGAGACCAGCTTCATCTTCACTGAGTTCCTGGAGCCGGCAGCCAATG<br>AGACCGTGCGGCACGGGTGTCTGCGCCTCAACCAGCCCACCCACGT<br>CAACAACGGCAACTACACGCTGCTGGCTGCCAACCCCTTCGGCCAG<br>GCCTCCGCCTCCATCATGGCTGCCTTCATGGACAACCCTTTCGAGTT<br>CAACCCCGAGGACCCCATCCCTGTCTCCTTCTCGCCGGTGGACACTA<br>ACAGCACATCTGGAGACCCGGTGGAGAAGAAGGACGAAACACCTTT<br>TGGGGTCTCGGTGGCTGTGGGCCTGGCCGTCTTTGCCTGCCTCTTCCT<br>TTCTACGCTGCTCCTTGTGCTCAACAAATGTGGACGGAGAAACAAGT<br>TTGGGATCAACCGCCCGGCTGTGCTGGCTCCAGAGGATGGGCTGGC<br>CATGTCCCTGCATTTCATGACATTGGGTGGCAGCTCCCTGTCCCCCA<br>CCGAGGGCAAAGGCTCTGGGCTCCAAGGCCACATCATCGAGAACCC<br>ACAATACTTCAGTGATGCCTGTGTTCACCACATCAAGCGCCGGGACA<br>TCGTGCTCAAGTGGGAGCTGGGGGAGGGCGCCTTTGGGAAGGTCTT<br>CCTTGCTGAGTGCCACAACCTCCTGCCTGAGCAGGACAAGATGCTGG<br>TGGCTGTCAAGGCACTGAAGGAGGCGTCCGAGAGTGCTCGGCAGGA<br>CTTCCAGCGTGAGGCTGAGCTGCTCACCATGCTGCAGCACCAGCACA<br>TCGTGCGCTTCTTCGGCGTCTGCACCGAGGGCCGCCCCCTGCTCATG<br>GTCTTTGAGTATATGCGGCACGGGGACCTCAACCGCTTCCTCCGATC<br>CCATGGACCTGATGCCAAGCTGCTGGCTGGTGGGGAGGATGTGGCT<br>CCAGGCCCCCTGGGTCTGGGGCAGCTGCTGGCCGTGGCTAGCCAGG<br>TCGCTGCGGGGATGGTGTACCTGGCGGGTCTGCATTTTGTGCACCGG<br>GACCTGGCCACACGCAACTGTCTAGTGGGCCAGGGACTGGTGGTCA<br>AGATTGGTGATTTTGGCATGAGCAGGGATATCTACAGCACCGACTAT<br>TACCGTGTGGGAGGCCGCACCATGCTGCCCATTCGCTGGATGCCGCC<br>CGAGAGCATCCTGTACCGTAAGTTCACCACCGAGAGCGACGTGTGG<br>AGCTTCGGCGTGGTGCTCTGGGAGATCTTCACCTACGGCAAGCAGCC<br>CTGGTACCAGCTCTCCAACACGGAGGCAATCGACTGCATCACGCAG<br>GGACGTGAGTTGGAGCGGCCACGTGCCTGCCCACCAGAGGTCTACG<br>CCATCATGCGGGGCTGCTGGCAGCGGGAGCCCCAGCAACGCCACAG<br>CATCAAGGATGTGCACGCCCGGCTGCAAGCCCTGGCCCAGGCACCT<br>CCTGTCTACCTGGATGTCCTGGGCTAG | 76 |
| NAB2-<br>NTRK1 | ATGCACAGAGCGCCTTCCCCCACAGCCGAGCAGCCGCCGGGCGGAG<br>GGGACAGCGCCCGCCGGACCCTGCAGCCCAGACTCAAGCCCAGTGC<br>CCGAGCCATGGCACTGCCTCGGACGCTGGGGGAGCTGCAGCTGTAC<br>CGGGTCCTGCAGCGCGCCAACCTCCTTTCCTACTATGAGACCTTCAT<br>CCAGCAGGGAGGGGACGACGTGCAGCAGCTGTGTGAGGCGGGTGA<br>GGAGGAGTTTCTGGAGATCATGGCACTTGTGGGCATGGCCACCAAG<br>CCCCTCCATGTCCGGCGCCTGCAGAAGGCACTGAGAGAGTGGGCCA<br>CCAATCCAGGGCTCTTCAGTCAACCAGTGCCTGCTGTTCCCGTCTCC<br>AGCATCCCGCTCTTCAAGATCTCTGAGACTGCGGGTACCCGGAAAG<br>GGAGCATGAGCAATGGGCATGGCAGCCCAGGGGAAAAGGCAGGCA<br>GTGCCCGCAGTTTTAGCCCCAAGAGCCCCCTTGAACTTGGAGAGAA<br>GCTATCACCACTGCCTGGGGGACCTGGGGCAGGGGACCCCCGGATC<br>TGGCCAGGCCGGAGCACTCCAGAGTCGGACGTTGGGGCAGGAGGAG<br>AAGAGGAGGCTGGCTCGCCCCCCTTCTCCCCCCCTGCAGGGGGAGG<br>AGTCCCTGAGGGGACTGGGGCTGGGGGGCTGGCAGCAGGTGGGACT<br>GGGGGTGGTCCAGACCGACTGGAGCCAGAGATGGTACGCATGGTGG<br>TGGAAAGTGTGGAGAGGATCTTCCGGAGCTTCCCAAGGGGGGATGC<br>TGGGGAGGTCACATCCCTGCTAAAGCTGAATAAGAAGCTGGCACGG<br>AGCGTTGGGCACATCTTTGAGATGGATGATAATGACAGCCAGAAGG | 77 |

TABLE P-continued

| Fusion Sequences. | | |
|---|---|---|
| Fusion | SEQUENCE | SEQ ID NO |
| | AAGAGGAGATCCGCAAATACAGCATCATCTATGGCCGTTTCGACTCT<br>AAGCGGCGGGAGGGCAAGCAGCTCAGCCTGCACGAGCTCACCATCA<br>ACGAGGCTGCTGCCCAGTTCTGCATGAGGGACAACACGCTCTTATTA<br>CGGAGAGTGGAGCTCTTCTCTTTGTCCCGCCAAGTAGCCCGAGAGAG<br>CACCTACTTGTCCTCCTTGAAGGGCTCCAGGCTTCACCCTGAAGAAC<br>TGGGAGGCCCTCCACTGAAGAAGCTGAAACAAGAGGTTGGAGAACA<br>GAGTCACCCTGAAATCCAGCAGCCTCCCCCAGGCCCTGAGTCCTATG<br>TACCCCCATACCGCCCCAGCCTGGAGGAGGACAGCGCCAGCCTGTC<br>TGGGGAGAGTCTGGATGGACATTTGCAGGACACTAACAGCACATCT<br>GGAGACCCGGTGGAGAAGAAGGACGAAACACCTTTTGGGGTCTCGG<br>TGGCTGTGGGCCTGGCCGTCTTTGCCTGCCTCTTCCTTTCTACGCTGC<br>TCCTTGTGCTCAACAAATGTGGACGGAGAAACAAGTTTGGGATCAA<br>CCGCCCGGCTGTGCTGGCTCCAGAGGATGGGCTGGCCATGTCCCTGC<br>ATTTCATGACATTGGGTGGCAGCTCCCTGTCCCCCACCGAGGGCAAA<br>GGCTCTGGGCTCCAAGGCCACATCATCGAGAACCCACAATACTTCA<br>GTGATGCCTGTGTTCACCACATCAAGCGCCGGGACATCGTGCTCAAG<br>TGGGAGCTGGGGGAGGGCGCCTTTGGGAAGGTCTTCCTTGCTGAGT<br>GCCACAACCTCCTGCCTGAGCAGGACAAGATGCTGGTGGCTGTCAA<br>GGCACTGAAGGAGGCGTCCGAGAGTGCTCGGCAGGACTTCCAGCGT<br>GAGGCTGAGCTGCTCACCATGCTGCAGCACCAGCACATCGTGCGCTT<br>CTTCGGCGTCTGCACCGAGGGCCGCCCCCTGCTCATGGTCTTTGAGT<br>ATATGCGGCACGGGGACCTCAACCGCTTCCTCCGATCCCATGGACCT<br>GATGCCAAGCTGCTGGCTGGTGGGGAGGATGTGGCTCCAGGCCCCC<br>TGGGTCTGGGGCAGCTGCTGGCCGTGGCTAGCCAGGTCGCTGCGGG<br>GATGGTGTACCTGGCGGGTCTGCATTTTGTGCACCGGGACCTGGCCA<br>CACGCAACTGTCTAGTGGGCCAGGGACTGGTGGTCAAGATTGGTGA<br>TTTTGGCATGAGCAGGGATATCTACAGCACCGACTATTACCGTGTGG<br>GAGGCCGCACCATGCTGCCCATTCGCTGGATGCCGCCCGAGAGCAT<br>CCTGTACCGTAAGTTCACCACCGAGAGCGACGTGTGGAGCTTCGGC<br>GTGGTGCTCTGGGAGATCTTCACCTACGGCAAGCAGCCCTGGTACCA<br>GCTCTCCAACACGGAGGCAATCGACTGCATCACGCAGGGACGTGAG<br>TTGGAGCGGCCACGTGCCTGCCCACCAGAGGTCTACGCCATCATGCG<br>GGGCTGCTGGCAGCGGGAGCCCCAGCAACGCCACAGCATCAAGGAT<br>GTGCACGCCCGGCTGCAAGCCCTGGCCCAGGCACCTCCTGTCTACCT<br>GGATGTCCTGGGCTAG | |
| NTRK1-<br>DUSP10 | ATGCTGCGAGGCGGACGGCGCGGGCAGCTTGGCTGGCACAGCTGGG<br>CTGCGGGGCCGGGCAGCCTGCTGGCTTGGCTGATACTGGCATCTGCG<br>GGCGCCGCACCCTGCCCCGATGCCTGCTGCCCCCACGGCTCCTCGGG<br>ACTGCGATGCACCCGGGATGGGGCCCTGGATAGCCTCCACCACCTG<br>CCCGGCGCAGAGAACCTGACTGAGCTCTACATCGAGAACCAGCAGC<br>ATCTGCAGCATCTGGAGCTCCGTGATCTGAGGGGCCTGGGGGAGCT<br>GAGAAACCTCACCATCGTGAAGAGTGGTCTCCGTTTCGTGGCGCCAG<br>ATGCCTTCCATTTCACTCCTCGGCTCAGTCGCCTGAATCTCTCCTTCA<br>ACGCTCTGGAGTCTCTCTCCTGGAAAACTGTGCAGGGCCTCTCCTTA<br>CAGGAACTGGTCCTGTCGGGGAACCCTCTGCACTGTTCTTGTGCCCT<br>GCGCTGGCTACAGCGCTGGGAGGAGGAGGGACTGGGCGGAGTGCCT<br>GAACAGAAGCTGCAGTGTCATGGGCAAGGGCCCCTGGCCCACATGC<br>CCAATGCCAGCTGTGGTGTGCCCACGCTGAAGGTCCAGGTGCCCAAT<br>GCCTCGGTGGATGTGGGGGACGACGTGCTGCTGCGGTGCCAGGTGG<br>AGGGGCGGGGCCTGGAGCAGGCCGGCTGGATCCTCACAGAGCTGGA<br>GCAGTCAGCCACGGTGATGAAATCTGGGGGTCTGCCATCCCTGGGG<br>CTGACCCTGGCCAATGTCACCAGTGACCTCAACAGGAAGAACGTGA<br>CGTGCTGGGCAGAGAACGATGTGGGCCGGGCAGAGGTCTCTGTTCA<br>GGTCAACGTCTCCTTCCCGGCCAGTGTGCAGCTGCACACGGCGGTGG<br>AGATGCACCACTGGTGCATCCCCTTCTCTGTGGATGGGCAGCCGGCA<br>CCGTCTCTGCGCTGGCTCTTCAATGGCTCCGTGCTCAATGAGACCAG<br>CTTCATCTTCACTGAGTTCCTGGAGCCGGCAGCCAATGAGACCGTGC<br>GGCACGGGTGTCTGCGCCTCAACCAGCCCACCCACGTCAACAACGG<br>CAACTACACGCTGCTGGCTGCCAACCCCTTCGGCCAGGCCTCCGCCT<br>CCATCATGGCTGCCTTCATGGACAACCCTTTCGAGTTCAACCCCGAG<br>GACCCCATCCCTGTCTCCTTCTCGCCGGTGGACACTAACAGCACATC<br>TGGAGACCCGGTGGAGAAGAAGGACGAAACACCTTTTGGGGTCTCG<br>GTGGCTGTGGGCCTGGCCGTCTTTGCCTGCCTCTTCCTTTCTACGCTG<br>CTCCTTGTGCTCAACAAATGTGGACGGAGAAACAAGTTTGGGATCA<br>ACCGTGGACTTAGTAGTTTTAAGCAGAACCATGAAAACCTCTGTGAC<br>AACTCCCTCCAGCTCCAAGAGTGCCGGGAGGTGGGGGGCGGCGCAT<br>CCGCGGCCTCGAGCTTGCTACCTCAGCCCATCCCCACCACCCCTGAC<br>ATCGAGAACGCTGAGCTCACCCCCATCTTGCCCTTCCTGTTCCTTGG<br>CAATGAGCAGGATGCTCAGGACCTGGACACCATGCAGCGGCTGAAC<br>ATCGGCTACGTCATCAACGTCACCACTCATCTTCCCCTCTACCACTAT<br>GAGAAAGGCCTGTTCAACTACAAGCGGCTGCCAGCCACTGACAGCA<br>ACAAGCAGAACCTGCGGCAGTACTTTGAAGAGGCTTTTGAGTTCATT<br>GAGGAAGCTCACCAGTGTGGGAAGGGGCTTCTCATCCACTGCCAGG<br>CTGGGGTGTCCCGCTCCGCCACCATCGTCATCGCTTACTTGATGAAG | 78 |

TABLE P-continued

| Fusion Sequences. | | |
|---|---|---|
| Fusion | SEQUENCE | SEQ ID NO |
| | CACACTCGGATGACCATGACTGATGCTTATAAATTTGTCAAAGGCAA<br>ACGACCAATTATCTCCCCAAACCTTAACTTCATGGGGCAGTTGCTAG<br>AGTTCGAGGAAGACCTAAACAACGGTGTGACACCGAGAATCCTTAC<br>ACCAAAGCTGATGGGCGTGGAGACGGTTGTGTGA | |
| NTRK1-NLGN1 | ATGCTGCGAGGCGGACGGCGCGGGCAGCTTGGCTGGCACAGCTGGG<br>CTGCGGGGCCGGGCAGCCTGCTGGCTTGGCTGATACTGGCATCTGCG<br>GGCGCCGCACCCTGCCCCGATGCCTGCTGCCCCCACGGCTCCTCGGG<br>ACTGCGATGCACCCGGGATGGGGCCCTGGATAGCCTCCACCACCTG<br>CCCGGCGCAGAGAACCTGACTGAGCTCTACATCGAGAACCAGCAGC<br>ATCTGCAGCATCTGGAGCTCCGTGATCTGAGGGGCCTGGGGGAGCT<br>GAGAAACCTCACCATCGTGAAGAGTGGTCTCCGTTTCGTGGCGCCAG<br>ATGCCTTCCATTTCACTCCTCGGCTCAGTCGCCTGAATCTCTCCTTCA<br>ACGCTCTGGAGTCTCTCTCCTGGAAAACTGTGCAGGGCCTCTCCTTA<br>CAGGAACTGGTCCTGTCGGGGAACCCTCTGCACTGTTCTTGTGCCCT<br>GCGCTGGCTACAGCGCTGGGAGGAGGAGGGACTGGGCGGAGTGCCT<br>GAACAGAAGCTGCAGTGTCATGGGCAAGGGCCCCTGGCCCACATGC<br>CCAATGCCAGCTGTGGTGTGCCCACGCTGAAGGTCCAGGTGCCCAAT<br>GCCTCGGTGGATGTGGGGGACGACGTGCTGCTGCGGTGCCAGGTGG<br>AGGGGCGGGGCCTGGAGCAGGCCGGCTGGATCCTCACAGAGCTGGA<br>GCAGTCAGCCACGGTGATGAAATCTGGGGGTCTGCCATCCCTGGGG<br>CTGACCCTGGCCAATGTCACCAGTGACCTCAACAGGAAGAACGTGA<br>CGTGCTGGGCAGAGAACGATGTGGGCCGGGCAGAGGTCTCTGTTCA<br>GGTCAACGTCTCCTGTTTCTTGAGTACAGGCGATCAGGCTGCAAAGG<br>GGAACTATGGACTCCTTGATCTCATACAAGCTTTAAGATGGACTAGT<br>GAAAACATTGGATTCTTTGGTGGTGACCCCTTAAGAATCACTGTTTT<br>TGGATCTGGTGCTGGGGGTTCATGTGTCAACCTGCTGACTTTATCCC<br>ATTATTCTGAAGGTAACCGTTGGAGCAATTCAACCAAAGGACTTTTT<br>CAACGAGCAATAGCTCAAAGTGGAACAGCCCTTTCCAGCTGGGCTG<br>TTAGTTTTCAACCTGCAAAATATGCTAGAATGTTGGCCACAAAAGTT<br>GGTTGCAATGTTTCAGATACAGTAGAGTTAGTGGAATGCCTACAGA<br>AGAAGCCTTACAAAGAACTTGTTGACCAAGATATTCAACCAGCTCG<br>ATACCACATAGCCTTTGGACCTGTGATTGATGGTGATGTAATACCAG<br>ACGACCCCCAGATATTGATGGAGCAAGGAGAGTTTCTCAACTATGA<br>TATAATGTTAGGAGTGAACCAAGGGGAAGGGTTAAAATTTGTTGAA<br>AATATAGTAGATAGCGATGATGGTATATCAGCTAGTGATTTTGACTT<br>TGCTGTTTCAAATTTTGTTGATAATTTATATGGATATCCTGAAGGCA<br>AAGATGTTTTGAGAGAAACCATTAAGTTCATGTATACTGACTGGGCT<br>GACCGTCATAACCCTGAAACCAGAAGAAAGACATTACTGGCTTTGTT<br>TACGGACCATCAGTGGGTGGCACCAGCTGTAGCCACAGCGGATCTT<br>CACTCAAACTTTGGTTCACCTACGTACTTCTATGCCTTTTACCATCAT<br>TGCCAAACAGATCAGGTTCCAGCTTGGGCTGATGCAGCCCACGGAG<br>ACGAGGTTCCCTATGTACTGGGAATCCCCATGATTGGCCCTACAGAG<br>TTATTTCCTTGCAATTTCTCCAAAAATGATGTGATGCTGAGTGCAGTT<br>GTAATGACATACTGGACAAATTTTGCTAAAACTGGTGACCCAAATCA<br>ACCAGTCCCTCAAGACACGAAATTCATTCATACCAAACCCAACCGTT<br>TTGAAGAAGTAGCATGGACCAGATATTCCCAGAAAGACCAACTTTA<br>TCTCCATATTGGATTAAAACCAAGAGTTAAAGAACATTACAGAGCC<br>AATAAGGTGAACCTCTGGTTGGAGTTGGTACCTCATCTGCATAATCT<br>CAATGACATTTCTCAGTATACCTCTACAACAACTAAAGTGCCATCAA<br>CTGACATCACTTTCAGACCTACGAGAAAAAATTCTGTACCTGTCACG<br>TCAGCCTTTCCCACTGCCAAGCAGGATGATCCCAAACAACAACCAA<br>GTCCATTTTCAGTGGATCAAAGGGACTACTCAACAGAGCTGAGTGTC<br>ACTATTGCAGTTGGAGCATCACTGCTGTTTCTGAACATCTTGGCCTTT<br>GCAGCCCTGTACTACAAAAAGGATAAGAGGAGACATGATGTTCACA<br>GGAGATGCAGCCCTCAGCGCACTACTACCAATGATCTAACCCATGC<br>ACAAGAAGAGGAAATCATGTCCCTCCAAATGAAGCACACTGATTTG<br>GATCATGAATGTGAGTCCATTCATCCACATGAGGTGGTTCTTCGGAC<br>CGCCTGTCCCCCAGATTACACACTAGCTATGAGGAGGTCACCTGATG<br>ATGTTCCCTTAATGACACCCAACACCATTACAATGATTCCCAACACT<br>ATACCAGGGATTCAGCCCTTACACACATTCAATACATTTACTGGAGG<br>ACAGAACAATACTCTGCCCCATCCCCATCCCCACCCCCATTCACATT<br>CAACAACCAGGGTATAG | 79 |
| NTRK1-DCST1 | ATGCTGCGAGGCGGACGGCGCGGGCAGCTTGGCTGGCACAGCTGGG<br>CTGCGGGGCCGGGCAGCCTGCTGGCTTGGCTGATACTGGCATCTGCG<br>GGCGCCGCACCCTGCCCCGATGCCTGCTGCCCCCACGGCTCCTCGGG<br>ACTGCGATGCACCCGGGATGGGGCCCTGGATAGCCTCCACCACCTG<br>CCCGGCGCAGAGAACCTGACTGAGCTCTACATCGAGAACCAGCAGC<br>ATCTGCAGCATCTGGAGCTCCGTGATCTGAGGGGCCTGGGGGAGCT<br>GAGAAACCTCACCATCGTGAAGAGTGGTCTCCGTTTCGTGGCGCCAG<br>ATGCCTTCCATTTCACTCCTCGGCTCAGTCGCCTGTCTTTCTCCTACA<br>TGGACAGCTATAACCATGACATTCGTTTTGACAACATCTACATCAGT<br>ACCTACTTCTGCCAGATCGATGACCGCAGGAAGAAGCTGGGCAAAC<br>GGACTCTGCTGCCACTCCGCAAAGCTGAGGAGAAAACCGTCATCTTC | 80 |

TABLE P-continued

Fusion Sequences.

| Fusion | SEQUENCE | SEQ ID NO |
|---|---|---|
| | CCTTGCAAGCCCACCATCCAGGCCTCAGAAATGAGCAATGTGGTGA<br>GGGAGCTCCTGGAGACACTGCCCATTCTGCTGCTGCTGGTGGTGCTG<br>TGTGGCTTGGACTGGGCTCTCTACTCCATCTTCGACACCATCCGCCA<br>CCACTCCTTCCTGCAGTACTCCTTCCGCAGCAGTCATAAACTGGAGG<br>TGAAGGTCGGGGGAGACTCCATGCTAGCCCGGCTTCTTCGAAAAAC<br>CATTGGGGCCCTGAACACCTCCTCAGAGACAGTGATGGAATCAAAC<br>AACATGCCCTGCCTGCCCCAGCCTGTGGGCCTGGATGCCAGGGCCTA<br>CTGGAGAGCTGCAGTACCGATTGGCCTGTTAGTGTGTCTCTGCCTGT<br>TACAGGCTTTTGGCTACCGACTCCGGAGGGTCATCGCAGCCTTCTAC<br>TTCCCCAAGCGAGAGAAGAAGCGGATCCTGTTCCTCTACAATGACCT<br>ATTGAAGAAAAGAGCAGCCTTCACCAAACTCAGGAGGGCCGCTATC<br>CTGAGGCGGGAGCGACAGCAGAAGGCTCCGCGCCACCCGCTGGCGG<br>ATATCCTGCACCGCGGCTGCCCGCTCCTGCGCCGCTGGCTGTGCCGG<br>CGCTGCGTGGTGTGCCAGGCACCCGAGACGCCCGAGTCCTACGTGT<br>GCCGGACGCTGGACTGCGAGGCCGTGTACTGCTGGTCGTGCTGGGA<br>CGACATGCGGCAGCGGTGCCCGGTCTGCACGCCCCGCGAAGAGCTC<br>TCTTCCTCCGCCTTTAGTGACAGCAACGACGACACTGCCTACGCGGG<br>GTGA | |
| MEX3A-<br>NTRK1 | ***ATG***CCTAGTCTAGTGGTATCTGGAATAATGGAAAGAAATGGGGGCT<br>TTGGAGAACTAGGATGTTTCGGGGGAAGCGCTAAGGACCGAGGGCT<br>GCTGGAAGACGAGCGCGCCCTTCAGCTGGCTCTCGATCAACTCTGCC<br>TCCTGGGTTTGGGGGAGCCCCCCGCCCCCACGGCGGGCGAGGACGG<br>GGGAGGTGGGGGGGGCGGCGCCCCCGCGCAGCCGGCCGCCCCCCCG<br>CAGCCGGCCCCGCCGCCGCCGCCCGCGGCGCCCCCGGCCGCCCCGA<br>CGGCGGCCCCCGCAGCGCAGACGCCCCAGCCCCCCACCGCCCCCAA<br>AGGGGCGAGCGACGCCAAGCTCTGCGCTCTCTACAAAGAGGCCGAG<br>CTGCGCCTGAAGGGCAGCAGCAACACCACGGAGTGTGTTCCCGTGC<br>CCACCTCCGAGCACGTGGCCGAGATCGTGGGCAGGCAAGTCTCCTTC<br>TCGCCGGTGGACACTAACAGCACATCTGGAGACCCGGTGGAGAAGA<br>AGGACGAAACACCTTTTGGGGTCTCGGTGGCTGTGGGCCTGGCCGTC<br>TTTGCCTGCCTCTTCCTTTCTACGCTGCTCCTTGTGCTCAACAAATGT<br>GGACGGAGAAACAAGTTTGGGATCAACCGCCCGGCTGTGCTGGCTC<br>CAGAGGATGGGCTGGCCATGTCCCTGCATTTCATGACATTGGGTGGC<br>AGCTCCCTGTCCCCCACCGAGGGCAAAGGCTCTGGGCTCCAAGGCC<br>ACATCATCGAGAACCCACAATACTTCAGTGATGCCTGTGTTCACCAC<br>ATCAAGCGCCGGGACATCGTGCTCAAGTGGGAGCTGGGGGAGGGCG<br>CCTTTGGGAAGGTCTTCCTTGCTGAGTGCCACAACCTCCTGCCTGAG<br>CAGGACAAGATGCTGGTGGCTGTCAAGGCACTGAAGGAGGCGTCCG<br>AGAGTGCTCGGCAGGACTTCCAGCGTGAGGCTGAGCTGCTCACCAT<br>GCTGCAGCACCAGCACATCGTGCGCTTCTTCGGCGTCTGCACCGAGG<br>GCCGCCCCCTGCTCATGGTCTTTGAGTATATGCGGCACGGGGACCTC<br>AACCGCTTCCTCCGATCCCATGGACCTGATGCCAAGCTGCTGGCTGG<br>TGGGGAGGATGTGGCTCCAGGCCCCCTGGGTCTGGGGCAGCTGCTG<br>GCCGTGGCTAGCCAGGTCGCTGCGGGGATGGTGTACCTGGCGGGTC<br>TGCATTTTGTGCACCGGGACCTGGCCACACGCAACTGTCTAGTGGGC<br>CAGGGACTGGTGGTCAAGATTGGTGATTTTGGCATGAGCAGGGATA<br>TCTACAGCACCGACTATTACCGTGTGGGAGGCCGCACCATGCTGCCC<br>ATTCGCTGGATGCCGCCCGAGAGCATCCTGTACCGTAAGTTCACCAC<br>CGAGAGCGACGTGTGGAGCTTCGGCGTGGTGCTCTGGGAGATCTTC<br>ACCTACGGCAAGCAGCCCTGGTACCAGCTCTCCAACACGGAGGCAA<br>TCGACTGCATCACGCAGGGACGTGAGTTGGAGCGGCCACGTGCCTG<br>CCCACCAGAGGTCTACGCCATCATGCGGGGCTGCTGGCAGCGGGAG<br>CCCCAGCAACGCCACAGCATCAAGGATGTGCACGCCCGGCTGCAAG<br>CCCTGGCCCAGGCACCTCCTGTCTACCTGGATGTCCTGGGCTAG | 5 |
| NOD1-<br>NTRK2 | ***atg***gaagagcagggccacagtgagatggaaataatcccatcagagtctcacccccaca<br>ttcaattactgaaaagcaatcgggaacttctggtcactcacatccgcaatactcagtg<br>tctggtggacaacttgctgaagaatgactacttctcggccgaagatgcggagattgtg<br>tgtgcctgccccacccagcctgacaaggtccgcaaaattctggacctggtacagagca<br>agggcgaggaggtgtccgagttcttcctctacttgctccagcaactcgcagatgccta<br>cgtggacctcaggccttggctgctggagatcggcttctccccttccctgctcactcag<br>agcaaagtcgtggtcaacactgacccagtgagcaggtatacccagcagctgcgacacc<br>atctgggccgtgactccaagttcgtgctgtgctatgcccagaaggaggagctgctgct<br>ggaggagatctacatggacaccatcatggagctggttggcttcagcaatgagagcctg<br>ggcagcctgaacagcctggcctgcctcctggaccacaccaccggcatcctcaatgagc<br>agggtgagaccatcttcatcctgggtgatgctggggtgggcaagtccatgctgctaca<br>gcggctgcagagcctctgggccacgggccggctagacgcaggggtcaaattcttcttc<br>cactttcgctgccgcatgttcagctgcttcaaggaaagtgacaggctgtgtctgcagg<br>acctgctcttcaagcactactgctacccagagcgggaccccgaggaggtgtttgcctt<br>cctgctgcgcttcccccacgtggccctcttcaccttcgatggcctggacgagctgcac<br>tcggacttggacctgagccgcgtgcctgacagctcctgcccctgggagcctgcccacc<br>ccctggtcttgctggccaacctgctcagtgggaagctgctcaagggggctagcaagct<br>gctcacagcccgcacaggcatcgaggtcccgcgccagttcctgcggaagaaggtgctt | 118 |

TABLE P-continued

Fusion Sequences.

| Fusion | SEQUENCE | SEQ ID NO |
|---|---|---|
| | ctccggggcttctcccccagccacctgcgcgcctatgccaggaggatgttccccgagc<br>gggccctgcaggaccgcctgctgagccagctggaggccaaccccaacctctgcagcct<br>gtgctctgtgcccctcttctgctggatcatcttccggtgcttccagcacttccgtgct<br>gcctttgaaggctcaccacagctgcccgactgcacgatgaccctgacagatgtcttcc<br>tcctggtcactgaggtccatctgaacaggatgcagcccagcagcctggtgcagcggaa<br>cacacgcagcccagtggagaccctccacgccggccgggacactctgtgctcgctgggg<br>caggtggcccaccggggcatggagaagagcctctttgtcttcacccaggaggaggtgc<br>aggcctccgggctgcaggagagagacatgcagctgggcttcctgcgggctttgccgga<br>gctgggccccgggggtgaccagcagtcctatgagtttttccacctcaccctccaggcc<br>ttctttacagccttcttcctcgtgctggacgacagggtgggcactcaggagctgctca<br>ggttcttccaggagtggatgcccctgcgggggcagcgaccacgtcctgctatcctcc<br>cttcctcccgttccagtgcctgcagggcagtggtccggcgcgggaagacctcttcaag<br>aacaaggatcacttccagttcaccaacctcttcctgtgcgggctgttgtccaaagcca<br>aacagaaactcctgcggcatctggtgcccgcggcagccctgaggagaaagcgcaaggc<br>cctgtgggcacacctgttttccagcctgcggggctacctgaagagcctgccccgcgtt<br>caggtcgaaagcttcaaccaggtgcaggccatgcccacgttcatctggatgctgcgct<br>gcatctacgagacacagagccagaaggtggggcagctggcggccaggggcatctgcgc<br>caactacctcaagctgacctactgcaacgcctgctcggccgactgcagcgccctctcc<br>ttcgtcctgcatcacttccccaagcggctggccctagacctagacaacaacaatctca<br>acgactacggcgtgcgggagctgcagccctgcttcagccgcctcactgttctcagact<br>cagcgtaaaccagatcactgacggtggggtaaaggtgctaagcgaagagctgaccaaa<br>tacaaaattgtgacctatttgggtttatacaacaaccagatcaccgatgtcggagcca<br>ggtacgtcaccaaaatcctggatgaatgcaaaggcctcacgcatcttaaactgggaaa<br>aaacaaaataacaagtgaaggagggaagtatctcgccctggctgtgaagaacagcaaa<br>tcaatctctgaggttgggatcctggtgggcaatccatttacatgctcctgtgacatta<br>tgtggatcaagactctccaagaggctaaatccagtccagacactcaggatttgtactg<br>cctgaatgaaagcagcaagaatattcccctggcaaacctgcagatacccaattgtggt<br>ttgccatctgcaaatctggccgcacctaacctcactgtggaggaaggaaagtctatca<br>cattatcctgtagtgtggcaggtgatccggttcctaatatgtattgggatgttggtaa<br>cctggtttccaaacatatgaatgaaacaagccacacacagggctccttaaggataact<br>aacatttcatccgatgacagtgggaagcagatctcttgtgtggcggaaaatcttgtag<br>gagaagatcaagattctgtcaacctcactgtgcattttgcaccaactatcacatttct<br>cgaatctccaacctcagaccaccactggtgcattccattcactgtgaaaggcaacccc<br>aaaccagcgcttcagtggttctataacggggcaatattgaatgagtccaaatacatct<br>gtactaaaatacatgttaccaatcacacggagtaccacggctgcctccagctggataa<br>tcccactcacatgaacaatggggactacactctaatagccaagaatgagtatgggaag<br>gatgagaaacagatttctgctcacttcatgggctggcctggaattgacgatggtgcaa<br>acccaaattatcctgatgtaatttatgaagattatggaactgcagcgaatgacatcgg<br>ggacaccacgaacagaagtaatgaaatcccttccacagacgtcactgataaaaccggt<br>cgggaacatctctcggtctatgctgtggtggtgattgcgtctgtggtgggattttgcc<br>ttttggtaatgctgtttctgcttaagttggcaagacactccaagtttggcatgaaaga<br>tttctcatggtttggatttgggaaagtaaaatcaagacaaggtgttggcccagcctcc<br>gttatcagcaatgatgatgactctgccagcccactccatcacatctccaatgggagta<br>acactccatcttcttcggaaggtggcccagatgctgtcattattggaatgaccaagat<br>ccctgtcattgaaaatccccagtactttggcatcaccaacagtcagctcaagccagac<br>acatttgttcagcacatcaagcgacataacattgttctgaaaagggagctaggcgaag<br>gagcctttggaaaagtgttcctagctgaatgctataacctctgtcctgagcaggacaa<br>gatcttggtggcagtgaagaccctgaaggatgccagtgacaatgcacgcaaggacttc<br>caccgtgaggccgagctcctgaccaacctccagcatgagcacatcgtcaagttctatg<br>gcgtctgcgtggagggcgacccccctcatcatggtctttgagtacatgaagcatgggga<br>cctcaacaagttcctcagggcacacggccctgatgccgtgctgatggctgagggcaac<br>ccgcccacggaactgacgcagtcgcagatgctgcatatagcccagcagatcgccgcgg<br>gcatggtctacctggcgtcccagcacttcgtgcaccgcgatttggccaccaggaactg<br>cctggtcggggagaacttgctggtgaaaatcggggactttgggatgtcccgggacgtg<br>tacagcactgactactacagggtcggtggccacacaatgctgcccattcgctggatgc<br>ctccagagagcatcatgtacaggaaattcacgacggaaagcgacgtctggagcctggg<br>ggtcgtgttgtgggagattttcacctatggcaaacagccctggtaccagctgtcaaac<br>aatgaggtgatagagtgtatcactcagggccgagtcctgcagcgaccccgcacgtgcc<br>cccaggaggtgtatgagctgatgctggggtgctggcagcgagagccccacatgaggaa<br>gaacatcaagggcatccataccctccttcagaacttggccaaggcatctccggtctac<br>ctggacattctaggctag | |
| PRRX1-NTRK2 | ATGACCTCCAGCTACGGGCACGTTCTGGAGCGGCAACCGGCGCTGG<br>GCGGCCGCTTGGACAGCCCGGGCAACCTCGACACCCTGCAGGCGAA<br>AAAGAACTTCTCCGTCAGTCACCTGCTAGACCTGGAGGAAGCCGGG<br>GACATGGTGGCGGCACAGGCGGATGAGAACGTGGGCGAGGCTGGCC<br>GGAGCCTGCTGGAGTCGCCGGGACTCACCAGCGGCAGCGACACCCC<br>GCAGCAGGACAATGACCAGCTGAACTCAGAAGAAAAAAAGAAGAG<br>AAAGCAGCGAAGGAATAGGACAACCTTCAATAGCAGCCAGCTGCAG<br>GCTTTGGAGCGTGTCTTTGAGCGGACACACTATCCTGATGCTTTTGT<br>GCGAGAAGACCTTGCCCGCCGGGTGAACCTCACCGAGGCGAGAGTG<br>CAGGTGTGGTTTCAGAACCGAAGAGCCAAGTTCCGCAGGAATGAGA<br>GAGCCATGCTAGCCAATAAAAACGCTTCCCTCCTCAAATCCTACTCA<br>GGAGACGTGACTGCTGTGGAGCAGCCCATCGTACCTCGTCCTGCTCC<br>GAGACCCACCGATTATCTCTCCTGGGGGACAGCGTCTCCGTACAGCA | 119 |

TABLE P-continued

| Fusion Sequences. | | |
|---|---|---|
| Fusion | SEQUENCE | SEQ ID NO |
| | ATTTTACCCGAAACAAACTGACGAGTTTGTCTAGGAAACATTTCCGT<br>CACCTTGACTTGTCTGAACTGATCCTGGTGGGCAATCCATTTACATG<br>CTCCTGTGACATTATGTGGATCAAGACTCTCCAAGAGGCTAAATCCA<br>GTCCAGACACTCAGGATTTGTACTGCCTGAATGAAAGCAGCAAGAA<br>TATTCCCCTGGCAAACCTGCAGATACCCAATTGTGGTTTGCCATCTG<br>CAAATCTGGCCGCACCTAACCTCACTGTGGAGGAAGGAAAGTCTAT<br>CACATTATCCTGTAGTGTGGCAGGTGATCCGGTTCCTAATATGTATT<br>GGGATGTTGGTAACCTGGTTTCCAAACATATGAATGAAACAAGCCA<br>CACACAGGGCTCCTTAAGGATAACTAACATTTCATCCGATGACAGTG<br>GGAAGCAGATCTCTTGTGTGGCGGAAAATCTTGTAGGAGAAGATCA<br>AGATTCTGTCAACCTCACTGTGCATTTTGCACCAACTATCACATTTCT<br>CGAATCTCCAACCTCAGACCACCACTGGTGCATTCCATTCACTGTGA<br>AAGGCAACCCCAAACCAGCGCTTCAGTGGTTCTATAACGGGGCAAT<br>ATTGAATGAGTCCAAATACATCTGTACTAAAATACATGTTACCAATC<br>ACACGGAGTACCACGGCTGCCTCCAGCTGGATAATCCCACTCACATG<br>AACAATGGGGACTACACTCTAATAGCCAAGAATGAGTATGGGAAGG<br>ATGAGAAACAGATTTCTGCTCACTTCATGGGCTGGCCTGGAATTGAC<br>GATGGTGCAAACCCAAATTATCCTGATGTAATTTATGAAGATTATGG<br>AACTGCAGCGAATGACATCGGGGACACCACGAACAGAAGTAATGAA<br>ATCCCTTCCACAGACGTCACTGATAAAACCGGTCGGGAACATCTCTC<br>GGTCTATGCTGTGGTGGTGATTGCGTCTGTGGTGGGATTTTGCCTTTT<br>GGTAATGCTGTTTCTGCTTAAGTTGGCAAGACACTCCAAGTTTGGCA<br>TGAAAGATTTCTCATGGTTTGGATTTGGGAAAGTAAAATCAAGACA<br>AGGTGTTGGCCCAGCCTCCGTTATCAGCAATGATGATGACTCTGCCA<br>GCCCACTCCATCACATCTCCAATGGGAGTAACACTCCATCTTCTTCG<br>GAAGGTGGCCCAGATGCTGTCATTATTGGAATGACCAAGATCCCTGT<br>CATTGAAAATCCCCAGTACTTTGGCATCACCAACAGTCAGCTCAAGC<br>CAGACACATTTGTTCAGCACATCAAGCGACATAACATTGTTCTGAAA<br>AGGGAGCTAGGCGAAGGAGCCTTTGGAAAAGTGTTCCTAGCTGAAT<br>GCTATAACCTCTGTCCTGAGCAGGACAAGATCTTGGTGGCAGTGAA<br>GACCCTGAAGGATGCCAGTGACAATGCACGCAAGGACTTCCACCGT<br>GAGGCCGAGCTCCTGACCAACCTCCAGCATGAGCACATCGTCAAGT<br>TCTATGGCGTCTGCGTGGAGGGCGACCCCCTCATCATGGTCTTTGAG<br>TACATGAAGCATGGGGACCTCAACAAGTTCCTCAGGGCACACGGCC<br>CTGATGCCGTGCTGATGGCTGAGGGCAACCCGCCCACGGAACTGAC<br>GCAGTCGCAGATGCTGCATATAGCCCAGCAGATCGCCGCGGGCATG<br>GTCTACCTGGCGTCCCAGCACTTCGTGCACCGCGATTTGGCCACCAG<br>GAACTGCCTGGTCGGGGAGAACTTGCTGGTGAAAATCGGGGACTTT<br>GGGATGTCCCGGGACGTGTACAGCACTGACTACTACAGGGTCGGTG<br>GCCACACAATGCTGCCCATTCGCTGGATGCCTCCAGAGAGCATCATG<br>TACAGGAAATTCACGACGGAAAGCGACGTCTGGAGCCTGGGGGTCG<br>TGTTGTGGGAGATTTTCACCTATGGCAAACAGCCCTGGTACCAGCTG<br>TCAAACAATGAGGTGATAGAGTGTATCACTCAGGGCCGAGTCCTGC<br>AGCGACCCCGCACGTGCCCCCAGGAGGTGTATGAGCTGATGCTGGG<br>GTGCTGGCAGCGAGAGCCCCACATGAGGAAGAACATCAAGGGCATC<br>CATACCCTCCTTCAGAACTTGGCCAAGGCATCTCCGGTCTACCTGGA<br>CATTCTAGGCTAG | |
| FAM117B-NTRK2 | ATGTCCCAGCGGGTGAGGCGCAATGGGTCCCCCACGCCGGCCGGCT<br>CCCTTGGGGGTGGTGCGGTGGCCACGGCCGGGGGACCCGGGAGCCG<br>CTTGCAGCCCATGAGGGCGACGGTTCCGTTCCAGCTGAAGCAGCAG<br>CAGCAGCAGCAACATGGCAGCCCCACGCGGAGCGGCGGCGGCGGC<br>GGCGGCAACAACAACGGTGGCTGCTGTGGTGGCGCCTCAGGCCCCG<br>CAGGCGGCGGCGGCGGCGGTGGCCCGCGCACCGCCTCGCGCAGCAC<br>CAGCCCCACGCGCGGCGGCGGGAACGCGGCCGCGCGCACCAGCCCC<br>ACGGTGGCCACGCAGACGGGCGCGTCCGCGACGTCCACGCGAGGCA<br>CCAGCCCCACGCGCAGCGCCGCGCCTGGAGCTCGCGGGAGCCCCCC<br>ACGGCCGCCGCCGCCGCCGCCGCTGCTGGGCACCGTGTCGTCGCCCA<br>GCTCGTCGCCCACCCACCTGTGGACCGGCGAGGTGAGCGCGGCCCC<br>ACCCCCAGCCCGCGTCCGGCATCGGAGGAGGTCTCCGGAGCAGAGC<br>CGAAGCTCGCCGGAGAAGAGGAGCCCCAGCGCCCCGGTTTGCAAAG<br>CAGATTTCTCATGGTTTGGATTTGGGAAAGTAAAATCAAGACAAGGT<br>GTTGGCCCAGCCTCCGTTATCAGCAATGATGATGACTCTGCCAGCCC<br>ACTCCATCACATCTCCAATGGGAGTAACACTCCATCTTCTTCGGAAG<br>GTGGCCCAGATGCTGTCATTATTGGAATGACCAAGATCCCTGTCATT<br>GAAAATCCCCAGTACTTTGGCATCACCAACAGTCAGCTCAAGCCAG<br>ACACATTTGTTCAGCACATCAAGCGACATAACATTGTTCTGAAAAGG<br>GAGCTAGGCGAAGGAGCCTTTGGAAAAGTGTTCCTAGCTGAATGCT<br>ATAACCTCTGTCCTGAGCAGGACAAGATCTTGGTGGCAGTGAAGAC<br>CCTGAAGGATGCCAGTGACAATGCACGCAAGGACTTCCACCGTGAG<br>GCCGAGCTCCTGACCAACCTCCAGCATGAGCACATCGTCAAGTTCTA<br>TGGCGTCTGCGTGGAGGGCGACCCCCTCATCATGGTCTTTGAGTACA<br>TGAAGCATGGGGACCTCAACAAGTTCCTCAGGGCACACGGCCCTGA<br>TGCCGTGCTGATGGCTGAGGGCAACCCGCCCACGGAACTGACGCAG<br>TCGCAGATGCTGCATATAGCCCAGCAGATCGCCGCGGGCATGGTCT | 120 |

TABLE P-continued

| Fusion Sequences. | | |
|---|---|---|
| Fusion | SEQUENCE | SEQ ID NO |
| | ACCTGGCGTCCCAGCACTTCGTGCACCGCGATTTGGCCACCAGGAAC<br>TGCCTGGTCGGGGAGAACTTGCTGGTGAAAATCGGGGACTTTGGGA<br>TGTCCCGGGACGTGTACAGCACTGACTACTACAGGGTCGGTGGCCA<br>CACAATGCTGCCCATTCGCTGGATGCCTCCAGAGAGCATCATGTACA<br>GGAAATTCACGACGGAAAGCGACGTCTGGAGCCTGGGGGTCGTGTT<br>GTGGGAGATTTTCACCTATGGCAAACAGCCCTGGTACCAGCTGTCAA<br>ACAATGAGGTGATAGAGTGTATCACTCAGGGCCGAGTCCTGCAGCG<br>ACCCCGCACGTGCCCCCAGGAGGTGTATGAGCTGATGCTGGGGTGC<br>TGGCAGCGAGAGCCCCACATGAGGAAGAACATCAAGGGCATCCATA<br>CCCTCCTTCAGAACTTGGCCAAGGCATCTCCGGTCTACCTGGACATT<br>CTAGGCTAG | |
| PAIP1-NTRK2 | ATGTCGGACGGTTTCGATCGGGCCCCAGGTGCTGGTCGGGGCCGGA<br>GCCGGGGCCTGGGCCGCGGAGGGGGCGGGCCTGAGGGCGGCGGTTT<br>CCCGAACGGAGCGGGGCCTGCTGAGCGGGCGCGGCACCAGCCGCCG<br>CAACCCAAAGCCCCGGGCTTCCTGCAGCCACCGCCGCTGCGCCAGC<br>CCAGGACGACCCCGCCGCCAGGGGCCCAGTGCGAGGTCCCCGCCAG<br>CCCCCAGCGGCCTTCCCGGCCCGGGGCGCTCCCAGAGCAAACGAGG<br>CCCCTGAGAGCTCCACCTAGTTCACAGGATAAAATCCCACAGCAGA<br>ACTCGGAGTCAGCAATGGCTAAGCCCCAGGTGGTTGTAGCTCCTGTA<br>TTAATGTCTAAGCTGTCTGTGAATGCCCCTGAATTTTACCCTTCAGGT<br>TATTCTTCCAGTTACACAGAATCCTATGAGGATGGTTGTGAGGATTA<br>TCCTACTCTATCAGAATATGTTCAGGATTTTTTGAATCATCTTACAGA<br>GCAGCCTGGCAGTTTTGAAACTGAAATTGAACAGTTTGCAGAGACC<br>CTGAATGGTTGTGTTACAACAGATGATGCTTTGCAAGAACTTGTGGA<br>ACTCATCTATCAACAGGCCACATCTATCCCAAATTTCTCTTATATGG<br>GAGCTCGCCTGTGTAATTACCTGTCCCATCATCTGACAATTAGCCCA<br>CAGAGTGGCAACTTCCGCCAATTGCTACTTCAAAGATGTCGGACTGA<br>ATATGAAGTTAAAGATCAAGCTGCAAAAGGGGATGAAGTTACTCGA<br>AAACGATTTCATGCATTTGTACTCTTTCTGGGAGAACTTTATCTTAAC<br>CTGGAGATCAAGGGAACAAATGGACAGGTTACAAGAGCAGATATTC<br>TTCAGGTTGGTCTTCGAGAATTGCTGAATGCCCTGTTTTCTAATCCTA<br>TGGATGACAATTTAATTTGTGCAGTAAAATTGTTAAAGTTGACAGGA<br>TCAGTTTTGGAAGATGCTTGGAAGGAAAAAGGAAAGATGGATATGG<br>AAGAAATTATTCAGAGAATTGAAAACGTTGTCCTAGATGCAAACTG<br>CAGTAGAGATGTAAAACAGATGCTCTTGAAGCTTGTAGAACTCCGG<br>TCAAGTAACTGGGGCAGAGTCCATGCAACTTCAACATATAGAGAAG<br>CAACACCAGAAAATGATCCTAACTACTTTATGAATGAACCAACATTT<br>TATACATCTGATGGTGTTCCTTTCACTGCAGCTGATCCAGATTATGG<br>AACTGCAGCGAATGACATCGGGGACACCACGAACAGAAGTAATGAA<br>ATCCCTTCCACAGACGTCACTGATAAAACCGGTCGGGAACATCTCTC<br>GGTCTATGCTGTGGTGGTGATTGCGTCTGTGGTGGGATTTTGCCTTTT<br>GGTAATGCTGTTTCTGCTTAAGTTGGCAAGACACTCCAAGTTTGGCA<br>TGAAAGATTTCTCATGGTTTGGATTTGGGAAAGTAAAATCAAGACA<br>AGGTGTTGGCCCAGCCTCCGTTATCAGCAATGATGATGACTCTGCCA<br>GCCCACTCCATCACATCTCCAATGGGAGTAACACTCCATCTTCTTCG<br>GAAGGTGGCCCAGATGCTGTCATTATTGGAATGACCAAGATCCCTGT<br>CATTGAAAATCCCCAGTACTTTGGCATCACCAACAGTCAGCTCAAGC<br>CAGACACATTTGTTCAGCACATCAAGCGACATAACATTGTTCTGAAA<br>AGGGAGCTAGGCGAAGGAGCCTTTGGAAAAGTGTTCCTAGCTGAAT<br>GCTATAACCTCTGTCCTGAGCAGGACAAGATCTTGGTGGCAGTGAA<br>GACCCTGAAGGATGCCAGTGACAATGCACGCAAGGACTTCCACCGT<br>GAGGCCGAGCTCCTGACCAACCTCCAGCATGAGCACATCGTCAAGT<br>TCTATGGCGTCTGCGTGGAGGGCGACCCCCTCATCATGGTCTTTGAG<br>TACATGAAGCATGGGGACCTCAACAAGTTCCTCAGGGCACACGGCC<br>CTGATGCCGTGCTGATGGCTGAGGGCAACCCGCCCACGGAACTGAC<br>GCAGTCGCAGATGCTGCATATAGCCCAGCAGATCGCCGCGGGCATG<br>GTCTACCTGGCGTCCCAGCACTTCGTGCACCGCGATTTGGCCACCAG<br>GAACTGCCTGGTCGGGGAGAACTTGCTGGTGAAAATCGGGGACTTT<br>GGGATGTCCCGGGACGTGTACAGCACTGACTACTACAGGGTCGGTG<br>GCCACACAATGCTGCCCATTCGCTGGATGCCTCCAGAGAGCATCATG<br>TACAGGAAATTCACGACGGAAAGCGACGTCTGGAGCCTGGGGGTCG<br>TGTTGTGGGAGATTTTCACCTATGGCAAACAGCCCTGGTACCAGCTG<br>TCAAACAATGAGGTGATAGAGTGTATCACTCAGGGCCGAGTCCTGC<br>AGCGACCCCGCACGTGCCCCCAGGAGGTGTATGAGCTGATGCTGGG<br>GTGCTGGCAGCGAGAGCCCCACATGAGGAAGAACATCAAGGGCATC<br>CATACCCTCCTTCAGAACTTGGCCAAGGCATCTCCGGTCTACCTGGA<br>CATTCTAGGCTAG | 121 |
| CTDSP2-NTRK2 | ATGGAACACGGCTCCATCATCACCCAGGCGCGGAGGGAAGACGCCC<br>TGGTGCTCACCAAGCAAGGCCCAGCCTCCGTTATCAGCAATGATGAT<br>GACTCTGCCAGCCCACTCCATCACATCTCCAATGGGAGTAACACTCC<br>ATCTTCTTCGGAAGGTGGCCCAGATGCTGTCATTATTGGAATGACCA<br>AGATCCCTGTCATTGAAAATCCCCAGTACTTTGGCATCACCAACAGT<br>CAGCTCAAGCCAGACACATTTGTTCAGCACATCAAGCGACATAACA | 122 |

TABLE P-continued

| Fusion Sequences. | | |
|---|---|---|
| Fusion | SEQUENCE | SEQ ID NO |
| | TTGTTCTGAAAAGGGAGCTAGGCGAAGGAGCCTTTGGAAAAGTGTT<br>CCTAGCTGAATGCTATAACCTCTGTCCTGAGCAGGACAAGATCTTGG<br>TGGCAGTGAAGACCCTGAAGGATGCCAGTGACAATGCACGCAAGGA<br>CTTCCACCGTGAGGCCGAGCTCCTGACCAACCTCCAGCATGAGCACA<br>TCGTCAAGTTCTATGGCGTCTGCGTGGAGGGCGACCCCCTCATCATG<br>GTCTTTGAGTACATGAAGCATGGGGACCTCAACAAGTTCCTCAGGGC<br>ACACGGCCCTGATGCCGTGCTGATGGCTGAGGGCAACCCGCCCACG<br>GAACTGACGCAGTCGCAGATGCTGCATATAGCCCAGCAGATCGCCG<br>CGGGCATGGTCTACCTGGCGTCCCAGCACTTCGTGCACCGCGATTTG<br>GCCACCAGGAACTGCCTGGTCGGGGAGAACTTGCTGGTGAAAATCG<br>GGGACTTTGGGATGTCCCGGGACGTGTACAGCACTGACTACTACAG<br>GGTCGGTGGCCACACAATGCTGCCCATTCGCTGGATGCCTCCAGAGA<br>GCATCATGTACAGGAAATTCACGACGGAAAGCGACGTCTGGAGCCT<br>GGGGGTCGTGTTGTGGGAGATTTTCACCTATGGCAAACAGCCCTGGT<br>ACCAGCTGTCAAACAATGAGGTGATAGAGTGTATCACTCAGGGCCG<br>AGTCCTGCAGCGACCCCGCACGTGCCCCCAGGAGGTGTATGAGCTG<br>ATGCTGGGGTGCTGGCAGCGAGAGCCCCACATGAGGAAGAACATCA<br>AGGGCATCCATACCCTCCTTCAGAACTTGGCCAAGGCATCTCCGGTC<br>TACCTGGACATTCTAGGCTAG | |
| PCSK5-<br>NTRK2 | ATGGGCTGGGGGAGCCGCTGCTGCTGCCCGGGACGTTTGGACCTGCT<br>GTGCGTGCTGGCGCTGCTCGGGGGCTGCCTGCTCCCCGTGTGTCGGA<br>CGCGCGTCTACACCAACCACTGGGCAGTCAAAATCGCCGGGGGCTT<br>CCCGGAGGCCAACCGTATCGCCAGCAAGTACGGATTCATCAACATA<br>GGACAGATAGGGGCCCTGAAGGACTACTACCACTTCTACCATAGCA<br>GGACGATTAAAAGGTCAGTTATCTCGAGCAGAGGGACCCACAGTTT<br>CATTTCAATGGAACCAAAGGTGGAATGGATCCAACAGCAAGTGGTA<br>AAAAAGCGGACAAAGAGGGATTATGACTTCAGTCGTGCCCAGTCTA<br>CCTATTTCAATGATCCCAAGTGGCCCAGCATGTGGTATATGCACTGC<br>AGTGACAATACACATCCCTGCCAGTCTGACATGAATATCGAAGGAG<br>CCTGGAAGAGAGGCTACACGGGAAAGAACATTGTGGTCACTATCCT<br>GGATGACGGAATTGAGAGAACCCATCCAGATCTGATGCAAAACTAC<br>GATGCTCTGGCAAGTTGCGACGTGAATGGGAATGACTTGGACCCAA<br>TGCCTCGTTATGATGCAAGCAACGAGAACAAGCATGGGACTCGCTG<br>TGCTGGAGAAGTGGCAGCCGCTGCAAACAATTCGCACTGCACAGTC<br>GGAATTGCTTTCAACGCCAAGATCGGAGGAGTGCGAATGCTGGACG<br>GAGATGTCACGGACATGGTTGAAGCAAAATCAGTTAGCTTCAACCC<br>CCAGCACGTGCACATTTACAGCGCCAGCTGGGGCCCGGATGATGAT<br>GGCAAGACTGTGGACGGACCAGCCCCCCTCACCCGGCAAGCCTTTG<br>AAAACGGCGTTAGAATGGGGCGGAGAGGCCTCGGCTCTGTGTTTGT<br>TTGGGCATCTGGAAATGGTGGAAGGAGCAAAGACCACTGCTCCTGT<br>GATGGCTACACCAACAGCATCTACACCATCTCCATCAGCAGCACTGC<br>AGAAAGCGGAAAGAAACCTTGGTACCTGGAAGAGTGTTCATCCACG<br>CTGGCCACAACCTACAGCAGCGGGGAGTCCTACGATAAGAAAATCA<br>TCACTACAGATCTGAGGCAGCGTTGCACGGACAACCACACTGGGAC<br>GTCAGCCTCAGCCCCCATGGCTGCAGGCATCATTGCGCTGGCCCTGG<br>AAGCCAATCCGTTTCTGACCTGGAGAGACGTACAGCATGTTATTGTC<br>AGGACTTCCCGTGCGGGACATTTGAACGCTAATGACTGGAAAACCA<br>ATGCTGCTGGTTTTAAGGTGAGCCATCTTTATGGATTTGGACTGATG<br>GACGCAGAAGCCATGGTGATGGAGGCAGAGAAGTGGACCACCGTTC<br>CCCGGCAGCACGTGTGTGTGGAGAGCACAGACCGACAAATCAAGAC<br>AATCCGCCCTAACAGTGCAGTGCGCTCCATCTACAAAGCTTCAGGCT<br>GCTCGGATAACCCCAACCGCCATGTCAACTACCTGGAGCACGTCGTT<br>GTGCGCATCACCATCACCCACCCCAGGAGAGGAGACCTGGCCATCT<br>ACCTGACCTCGCCCTCTGGAACTAGGTCTCAGCTTTTGGCCAACAGG<br>CTATTTGATCACTCCATGGAAGGATTCAAAAACTGGGAGTTCATGAC<br>CATTCATTGCTGGGGAGAAAGAGCTGCTGGTGACTGGGTCCTTGAA<br>GTTTATGATACTCCCTCTCAGCTAAGGAACTTTAAGACTCCAGGTAA<br>ATTGAAAGAATGGTCTTTGGTCCTCTACGGCACCTCCGTGCAGCCAT<br>ATTCACCAACCAATGAATTTCCGAAAGTGGAACGGTTCCGCTATAGC<br>CGAGTTGAAGACCCCACAGACGACTATGGCACAGAGGATTATGCAG<br>GTCCCTGCGACCCTGAGTGCAGTGAGGTTGGCTGTGACGGGCCAGG<br>ACCAGACCACTGCAATGACTGTTTGCACTACTACTACAAGCTGAAAA<br>ACAATACCAGGATCTGTGTCTCCAGCTGCCCCCCTGGCCACTACCAC<br>GCCGACAAGAAGCGCTGCAGGAAGTGTGCCCCCAACTGTGAGTCCT<br>GCTTTGGGAGCCATGGTGACCAATGCATGTCCTGCAAATATGGATAC<br>TTTCTGAATGAAGAAACCAACAGCTGTGTTACTCACTGCCCTGATGG<br>GTCATATCAGGATACCAAGAAAAATCTTTGCCGGAAATGCAGTGAA<br>AACTGCAAGACATGTACTGAATTCCATAACTGTACAGAATGTAGGG<br>ATGGGTTAAGCCTGCAGGGATCCCGGTGCTCTGTCTCCTGTGAAGAT<br>GGACGGTATTTCAACGGCCAGGACTGCCAGCCCTGCCACCGCTTCTG<br>CGCCACTTGTGCTGGGGCAGGAGCTGATGGGTGCATTAACTGCACA<br>GAGGGCTACTTCATGGAGGATGGGAGATGCGTGCAGAGCTGTAGTA<br>TCAGCTATTACTTTGACCACTCTTCAGAGAATGGATACAAATCCTGC<br>AAAAAATGTGATATCAGTTGTTTGACGTGCAATGGCCCAGGATTCAA | 123 |

TABLE P-continued

| Fusion Sequences. | | |
|---|---|---|
| Fusion | SEQUENCE | SEQ ID NO |
| | GAACTGTACAAGCTGCCCTAGTGGGTATCTCTTAGACTTAGGAATGT<br>GTCAAATGGGAGCCATTTGCAAGGATGGAGAATATGTTGATGAGCA<br>TGGCCACTGCCAGACCTGTGAGGCCTCATGTGCCAAGTGCCAGGGA<br>CCAACCCAGGAAGACTGCACTACCTGCCCCATGACAAGGATTTTTGA<br>TGATGGCCGCTGTGTTTCGAACTGCCCCTCATGGAAATTTGAATTTG<br>AGAACCAATGCCATCCATGCCACCACACCTGCCAGAGATGCCAAGG<br>AAGTGGCCCTACCCACTGCACCTCCTGTGGAGCAGACAACTATGGCC<br>GAGAGCACTTCCTGTACCAGGGAGAGTGTGGAGATAGCTGCCCAGA<br>GGGCCACTATGCCACTGAGGGGAACACCTGCCTGCCCTGCCCAGAC<br>AACTGTGAGCTTTGCCACAGCGTGCATGTCTGCACAAGATGCATGAA<br>GGGCTACTTCATAGCGCCCACCAACCACACATGCCAGAAGTTAGAG<br>TGTGGACAAGGTGAAGTCCAAGACCCAGACTATGAAGAATGTGTCC<br>CTTGTGAAGAAGGATGTCTGGGATGCAGCTTGGATTATGGAACTGC<br>AGCGAATGACATCGGGGACACCACGAACAGAAGTAATGAAATCCCT<br>TCCACAGACGTCACTGATAAAACCGGTCGGGAACATCTCTCGGTCTA<br>TGCTGTGGTGGTGATTGCGTCTGTGGTGGGATTTTGCCTTTTGGTAAT<br>GCTGTTTCTGCTTAAGTTGGCAAGACACTCCAAGTTTGGCATGAAAG<br>ATTTCTCATGGTTTGGATTTGGGAAAGTAAAATCAAGACAAGGTGTT<br>GGCCCAGCCTCCGTTATCAGCAATGATGATGACTCTGCCAGCCCACT<br>CCATCACATCTCCAATGGGAGTAACACTCCATCTTCTTCGGAAGGTG<br>GCCCAGATGCTGTCATTATTGGAATGACCAAGATCCCTGTCATTGAA<br>AATCCCCAGTACTTTGGCATCACCAACAGTCAGCTCAAGCCAGACAC<br>ATTTGTTCAGCACATCAAGCGACATAACATTGTTCTGAAAAGGGAGC<br>TAGGCGAAGGAGCCTTTGGAAAAGTGTTCCTAGCTGAATGCTATAA<br>CCTCTGTCCTGAGCAGGACAAGATCTTGGTGGCAGTGAAGACCCTG<br>AAGGATGCCAGTGACAATGCACGCAAGGACTTCCACCGTGAGGCCG<br>AGCTCCTGACCAACCTCCAGCATGAGCACATCGTCAAGTTCTATGGC<br>GTCTGCGTGGAGGGCGACCCCCTCATCATGGTCTTTGAGTACATGAA<br>GCATGGGGACCTCAACAAGTTCCTCAGGGCACACGGCCCTGATGCC<br>GTGCTGATGGCTGAGGGCAACCCGCCCACGGAACTGACGCAGTCGC<br>AGATGCTGCATATAGCCCAGCAGATCGCCGCGGGCATGGTCTACCT<br>GGCGTCCCAGCACTTCGTGCACCGCGATTTGGCCACCAGGAACTGCC<br>TGGTCGGGGAGAACTTGCTGGTGAAAATCGGGGACTTTGGGATGTC<br>CCGGGACGTGTACAGCACTGACTACTACAGGGTCGGTGGCCACACA<br>ATGCTGCCCATTCGCTGGATGCCTCCAGAGAGCATCATGTACAGGAA<br>ATTCACGACGGAAAGCGACGTCTGGAGCCTGGGGGTCGTGTTGTGG<br>GAGATTTTCACCTATGGCAAACAGCCCTGGTACCAGCTGTCAAACAA<br>TGAGGTGATAGAGTGTATCACTCAGGGCCGAGTCCTGCAGCGACCC<br>CGCACGTGCCCCCAGGAGGTGTATGAGCTGATGCTGGGGTGCTGGC<br>AGCGAGAGCCCCACATGAGGAAGAACATCAAGGGCATCCATACCCT<br>CCTTCAGAACTTGGCCAAGGCATCTCCGGTCTACCTGGACATTCTAG<br>GCTAG | |
| BLM-<br>NTRK3 | ***atg***gctgctgttcctcaaaataatctacaggagcaactagaacgtcactcagccagaa<br>cacttaataataaattaagtctttcaaaaccaaaattttcaggtttcacttttaaaaa<br>gaaaacatcttcagataacaatgtatctgtaactaatgtgtcagtagcaaaaacacct<br>gtattaagaaataaagatgttaatgttaccgaagacttttccttcagtgaacctctac<br>ccaacaccacaaatcagcaaagggtcaaggacttctttaaaaatgctccagcaggaca<br>ggaaacacagagaggtggatcaaaatcattattgccagatttcttgcagactccgaag<br>gaagttgtatgcactacccaaaacacaccaactgtaaagaaatcccgggatactgctc<br>tcaagaaattagaatttagttcttcaccagattctttaagtaccatcaatgattggga<br>tgatatggatgactttgatacttctgagacttcaaaatcatttgttacaccaccccaa<br>agtcactttgtaagagtaagcactgctcagaaatcaaaaaagggtaagagaaactttt<br>ttaaagcacagctttatacaacaaacacagtaaagactgatttgcctccaccctcctc<br>tgaaagcgagcaaatagatttgactgaggaacagaaggatgactcagaatggttaagc<br>agcgatgtgatttgcatcgatgatggccccattgctgaagtgcatataaatgaagatg<br>ctcaggaaagtgactctctgaaaactcatttggaagatgaaagaggtcccgtggctgt<br>catcagtggtgaggaggactcagccagcccactgcaccacatcaaccacggcatcacc<br>acgccctcgtcactggatgccgggcccgacactgtggtcattggcatgactcgcatcc<br>ctgtcattgagaacccccagtacttccgtcagggacacaactgccacaagccggacac<br>gtatgtgcagcacattaagaggagagacatcgtgctgaagcgagaactgggtgaggga<br>gcctttggaaaggtcttcctggccgagtgctacaacctcagcccgaccaaggacaaga<br>tgcttgtggctgtgaaggccctgaaggatcccaccctggctgcccggaaggatttcca<br>gagggaggccgagctgctcaccaacctgcagcatgagcacattgtcaagttctatgga<br>gtgtgcggcgatggggacccccctcatcatggtctttgaatacatgaagcatggagacc<br>tgaataagttcctcagggcccatgggccagatgcaatgatccttgtggatggacagcc<br>acgccaggccaagggtgagctggggctctcccaaatgctccacattgccagtcagatc<br>gcctcgggtatggtgtacctggcctcccagcactttgtgcaccgagacctggccacca<br>ggaactgcctggttggagcgaatctgctagtgaagattggggacttcggcatgtccag<br>agatgtctacagcacggattattacagggtgggaggacacaccatgctccccattcgc<br>tggatgcctcctgaaagcatcatgtaccggaagttcactacagagagtgatgtatgga<br>gcttcggggtgatcctctgggagatcttcacctatggaaagcagccatggttccaact<br>ctcaaacacggaggtcattgagtgcattacccaaggtcgtgttttggagcggccccga | 168 |

TABLE P-continued

Fusion Sequences.

| Fusion | SEQUENCE | SEQ ID NO |
|---|---|---|
| | gtctgccccaaagaggtgtacgatgtcatgctggggtgctggcagagggaaccacagc<br>agcggttgaacatcaaggagatctacaaaatcctccatgctttggggaaggccacccc<br>aatctacctggacattcttggctag | |
| NTRK3-<br>EFTUD1 | ATGGATGTCTCTCTTTGCCCAGCCAAGTGTAGTTTCTGGCGGATTTTC<br>TTGCTGGGAAGCGTCTGGCTGGACTATGTGGGCTCCGTGCTGGCTTG<br>CCCTGCAAATTGTGTCTGCAGCAAGACTGAGATCAATTGCCGGCGGC<br>CGGACGATGGGAACCTCTTCCCCCTCCTGGAAGGGCAGGATTCAGG<br>GAACAGCAATGGGAACGCCAGTATCAACATCACGGACATCTCAAGG<br>AATATCACTTCCATACACATAGAGAACTGGCGCAGTCTTCACACGCT<br>CAACGCCGTGGACATGGAGCTCTACACCGGACTTCAAAAGCTGACC<br>ATCAAGAACTCAGGACTTCGGAGCATTCAGCCCAGAGCCTTTGCCA<br>AGAACCCCCATTTGCGTTATATAAACCTGTCAAGTAACCGGCTCACC<br>ACACTCTCGTGGCAGCTCTTCCAGACGCTGAGTCTTCGGGAATTGCA<br>GTTGGAGCAGAACTTTTTCAACTGCAGCTGTGACATCCGCTGGATGC<br>AGCTCTGGCAGGAGCAGGGGGAGGCCAAGCTCAACAGCCAGAACCT<br>CTACTGCATCAACGCTGATGGCTCCCAGCTTCCTCTCTTCCGCATGA<br>ACATCAGTCAGTGTGACCTTCCTGAGATCAGCGTGAGCCACGTCAAC<br>CTGACCGTACGAGAGGGTGACAACGCTGTTATCACTTGCAATGGCTC<br>TGGATCACCCCTTCCTGATGTGGACTGGATAGTCACTGGGCTGCAGT<br>CCATCAACACTCACCAGACCAATCTGAACTGGACCAATGTTCATGCC<br>ATCAACTTGACGCTGGTGAATGTGACGAGTGAGGACAATGGCTTCA<br>CCCTGACGTGCATTGCAGAGAACGTGGTGGGCATGAGCAATGCCAG<br>TGTTGCCCTCACTGTCTACTATCCCCCACGTGTGGTGAGCCTGGAGG<br>AGCCTGAGCTGCGCCTGGAGCACTGCATCGAGTTTGTGGTGCGTGGC<br>AACCCCCCACCAACGCTGCACTGGCTGCACAATGGGCAGCCTCTGC<br>GGGAGTCCAAGATCATCCATGTGGAATACTACCAAGAGGGAGAGAT<br>TTCCGAGGGCTGCCTGCTCTTCAACAAGCCCACCCACTACAACAATG<br>GCAACTATACCCTCATTGCCAAAAACCCACTGGGCACAGCCAACCA<br>GACCATCAATGGCCACTTCCTCAAGGAGCCCTTTCCAGAGAGCACG<br>GATAACTTTATCTTGTGTGAAATGCCTCAGCTCGTAAAAGGAATGAA<br>ACTGTTAAACCAGGCTGATCCCTGTGTCCAGATTTTAATTCAGGAAA<br>CGGGAGAGCACGTTTTAGTCACAGCAGGAGAAGTCCACCTTCAGCG<br>ATGCCTGGATGACTTAAAAGAAAGGTTTGCAAAGATTCATATCAGT<br>GTATCTGAACCTATTATTCCATTCAGAGAAACAATCACAAAACCCCC<br>AAAAGTTGACATGGTCAATGAAGAAATAGGCAAACAGCAAAAAGTT<br>GCAGTCATACACCAAATGAAAGAAGATCAAAGCAAAATCCCTGAAG<br>GAATCCAAGTTGACTCTGACGGGCTAATCACCATAACAACTCCCAAT<br>AAACTTGCCACGCTCAGTGTTCGAGCCATGCCCCTTCCAGAAGAAGT<br>CACCCAGATTCTGGAAGAAAATAGTGATTTGATTCGTTCTATGGAGC<br>AGTTGACATCCTCTTTGAATGAGGGTGAAAATACTCACATGATTCAT<br>CAGAAGACCCAAGAGAAAATTTGGGAATTCAAAGGAAAACTGGAG<br>CAACACCTAACAGGGAGAAGATGGAGGAACATTGTTGACCAAATCT<br>GGTCATTTGGCCCAAGAAAATGTGGGCCCAACATACTAGTCAATAA<br>AAGTGAAGATTTTCAGAACTCAGTATGGACAGGTCCAGCTGACAAA<br>GCTTCAAAAGAAGCCAGTAGATACCGAGATTTGGGCAATAGCATTG<br>TGAGTGGCTTCCAACTAGCAACCCTCTCTGGCCCCATGTGTGAGGAG<br>CCTCTCATGGGTGTCTGTTTTGTTCTGGAAAAATGGACCTAAGTAA<br>ATTTGAGGAACAAGGAGCAAGTGATCTGGCAAAAGAGGGACAGGA<br>GGAAAATGAAACCTGTTCTGGTGGAAATGAAAACCAAGAGCTACAA<br>GATGGCTGCTCTGAGGCCTTTGAGAAGAGGACATCACAGAAAGGAG<br>AATCTCCACTCACTGACTGCTATGGACCTTTCTCAGGACAGCTAATT<br>GCCACCATGAAAGAAGCATGTCGCTATGCACTGCAAGTGAAACCTC<br>AGCGCCTGATGGCAGCTATGTACACATGTGACATCATGGCCACTGGT<br>GATGTTCTCGGTCGAGTCTATGCTGTCTTGTCAAAGAGAGAAGGTCG<br>GGTACTTCAAGAAGAAATGAAAGAAGGGACAGACATGTTCATCATC<br>AAGGCTGTGCTGCCTGTTGCTGAAAGCTTTGGTTTTGCTGATGAAAT<br>CAGGAAGAGGACAAGTGGCCTGGCCAGCCCACAACTAGTATTCAGC<br>CATTGGGAGATCATTCCCAGTGACCCCTTCTGGGTGCCAACTACTGA<br>GGAGGAATACTTGCACTTTGGGGAGAAGGCTGACTCTGAGAACCAA<br>GCCCGGAAGTACATGAACGCAGTACGAAAGCGGAAGGGGCTTTATG<br>TGGAAGAAAAGATTGTGGAGCATGCAGAAAAGCAGAGGACACTCA<br>GCAAAAATAAGTAG | 169 |
| NTRK3-<br>LRRK1 | ***atg***gatgtctctctttgcccagccaagtgtagtttctggcggattttcttgctgggaa<br>gcgtctggctggactatgtgggctccgtgctggcttgccctgcaaattgtgtctgcag<br>caagactgagatcaattgccggcggccggacgatgggaacctcttccccctcctggaa<br>gggcaggattcagggaacagcaatgggaacgccagtatcaacatcacggacatctcaa<br>ggaatatcacttccatacacatagagaactggcgcagtcttcacacgctcaacgccgt<br>ggacatggagctctacaccggacttcaaaagctgaccatcaagaactcaggacttcgg<br>agcattcagcccagagcctttgccaagaacccccatttgcgttatatctacctcctgc<br>cccatctccttccatctaaacctggcctggacacccacggtatgcggcaccccacagc<br>caacaccattcagagggtatttaagatgagcttcgttcccgttggcttctggcaaagg<br>tttatagcacggatgctgatcagcctggcggagatggacctgcagctttttgaaaaca<br>agaagaatactaaaagcaggaacaggaaagtcaccatttacagttttacaggaaacca | 170 |

TABLE P-continued

Fusion Sequences.

| Fusion | SEQUENCE | SEQ ID NO |
|---|---|---|
| | gagaaatcgctgtagcacattcagagtgaaaagaaatcagaccatctattggcaggaa<br>gggctcctggtcacttttgatgggggctacctcagtgtggaatcttccgacgtgaact<br>ggaaaaagaagaaaagcggaggaatgaaaattgtttgccaatcagaagtgagggactt<br>ctcagccatggctttcatcacggaccacgtcaattccttgattgatcagtggtttccc<br>gccctgacagccacagagagcgacgggacgccactcatggagcagtacgtgccctgcc<br>cggtctgcgagacagcctgggcccagcacacggaccccagtgagaaatcagaggatgt<br>gcagtacttcgacatggaagactgtgtcctgacggccatcgagcgggacttcatctcc<br>tgccccagacacccggacctccccgtgccgctgcaggagctggtccctgaactgttca<br>tgaccgacttcccggccaggctcttcctggagaacagcaagctggagcacagcgagga<br>cgagggcagcgtcctgggccagggcggcagtggcaccgtcatctaccgggcccggtac<br>cagggccagcctgtggccgtcaagcgcttccacatcaaaaaattcaagaactttgcta<br>acgtaccggcagacaccatgctgaggcacctgcgggccaccgatgccatgaagaactt<br>ctccgagttccggcaggaggccagcatgctgcacgcgctgcagcacccctgcatcgtg<br>gcgctcatcggcatcagcatccacccgctctgcttcgccctggagctcgcgccgctca<br>gcagcctcaacaccgtgctgtccgagaacgccagagattcttcctttataccccctggg<br>acacatgctcacccaaaaaatagcctaccagatcgcctcgggcctggcctacctgcac<br>aagaaaaacatcatcttctgtgacctgaagtcggacaacattctggtgtggtcccttg<br>acgtcaaggagcacatcaacatcaagctatctgactacgggatttcgaggcagtcatt<br>ccatgagggcgccctaggcgtggagggcactcctggctaccaggccccagagatcagg<br>cctcgcattgtatatgatgagaaggtagatatgttctcctatggaatggtgctctacg<br>agttgctgtcaggacagcgccctgcactgggccaccaccagctccagattgccaagaa<br>gctgtccaagggcatccgcccggttctggggcagccggaggaagtgcagttccggcga<br>ctgcaggcgctcatgatggagtgctgggacactaagccagagaagcgaccgctggccc<br>tgtcggtggtgagccagatgaaggacccgacttttgccaccttcatgtatgaactgtg<br>ctgtgggaagcagacagccttcttctcatcccagggccaggagtacaccgtggtgttt<br>tgggatggaaaagaggagtccaggaactacacggtggtgaacacagagaagggcctca<br>tggaggtgcagaggatgtgctgccctgggatgaaggtgagctgccagctccaggtcca<br>gagatccctgtggacagccaccgaggaccagaaaatctacatctacaccctcaagggc<br>atgtgccccttaaacacaccccaacaggccttggatactccagctgtcgtcacctgct<br>tcttggccgtgcctgttattaaaaagaattcctacctggtcttagcgggcctcgccga<br>tgggcttgtggctgtgtttcccgtggtgcggggcaccccaaaggacagctgctcctac<br>ctgtgctcacacacagccaacaggtccaagttcagcatcgcggatgaagacgcacggc<br>agaacccctacccagtgaaggccatggaggtggtcaacagcggctctgaggtctggta<br>cagcaatgggccgggcctccttgtcatcgactgtgcctccctggagatctgcaggcgg<br>ctggagccctacatggccccctccatggttacgtcagtcgtgtgcagctctgagggca<br>gaggggaggaggtcgtctggtgcctggatgacaaggccaactccttggtgatgtacca<br>ctccaccacctaccagctgtgtgcccggtacttctgcggggtccccagccccctcagg<br>gacatgtttcccgtgcggcccttggacacggaaccccggcagccagccacacggcca<br>acccaaaggtgcctgaggggactccatcgcggacgtgagcatcatgtacagtgagga<br>gctgggcacgcagatcctgatccaccaggaatcactcactgactactgctccatgtcc<br>tcctactcctcatccccaccccgccaggctgccaggtcccccctcaagcctccccagct<br>ccccagcaagttcttccagtgtgcctttctccaccgactgcgaggactcagacatgct<br>acatacgcccggtgctgcctccgacaggtctgagcatgacctgacccccatggacggg<br>gagaccttcagccagcacctgcaggccgtgaagatcctcgccgtcagagacctcattt<br>gggtccccaggcgcggtggagatgttatcgtcattggcctggagaaggattctggcgc<br>ccagcggggccgagtcattgccgtcttaaaagcccgagagctgactccgcatggggtg<br>ctggtggatgctgccgtggtggcaaaggacactgttgtgtgcacctttgaaaatgaaa<br>acacagagtggtgcctggccgtctggaggggctggggcgccagggagttcgacatttt<br>ctaccagtcctacgaggagctgggccggctggaggcttgcactcgcaagagaaggtaa | |
| HMBOX1-NTRK3 | ATGCTTAGTTCCTTTCCAGTGGTTTTGCTGGAAACCATGTCTCATTAT<br>ACAGATGAACCCAGATTTACCATAGAGCAGATAGATCTGCTTCAGC<br>GACTTCGGCGTACTGGAATGACTAAACATGAAATTCTCCATGCCTTG<br>GAAACTTTGGACCGTCTTGATCAAGAGCATAGTGACAAGTTTGGAA<br>GAAGGTCCAGCTATGGAGGAAGTTCATATGGGAATAGTACTAACAA<br>TGTCCCAGCATCTTCCTCTACAGCTACAGCTTCCACACAGACGCAGC<br>ATTCGGGAATGTCCCCGTCACCTAGCAACAGTTATGATACTTCCCCA<br>CAGCCTTGCACTACCAATCAAAATGGGAGGGAGAATAATGAGCGAT<br>TATCTACATCCAATGGAAAGATGTCACCAACTCGCTACCATGCAAAC<br>AGCATGGGTCAGAGGTCATACAGTTTTGAAGCCTCAGAAGAGGACC<br>TAGATGTAGATGATAAAGTGGAAGAATTAATGAGGAGGGACAGCAG<br>TGTGATAAAAGAGGAAATCAAAGCCTTTCTTGCCAATCGGAGGATTT<br>CCCAAGCAGTTGTTGCACAGGTAACAGGTCCCGTGGCTGTCATCAGT<br>GGTGAGGAGGACTCAGCCAGCCCACTGCACCACATCAACCACGGCA<br>TCACCACGCCCTCGTCACTGGATGCCGGGCCCGACACTGTGGTCATT<br>GGCATGACTCGCATCCCTGTCATTGAGAACCCCCAGTACTTCCGTCA<br>GGGACACAACTGCCACAAGCCGGACACGTATGTGCAGCACATTAAG<br>AGGAGAGACATCGTGCTGAAGCGAGAACTGGGTGAGGGAGCCTTTG<br>GAAAGGTCTTCCTGGCCGAGTGCTACAACCTCAGCCCGACCAAGGA<br>CAAGATGCTTGTGGCTGTGAAGGCCCTGAAGGATCCCACCCTGGCTG<br>CCCGGAAGGATTTCCAGAGGGAGGCCGAGCTGCTCACCAACCTGCA<br>GCATGAGCACATTGTCAAGTTCTATGGAGTGTGCGGCGATGGGGAC<br>CCCCTCATCATGGTCTTTGAATACATGAAGCATGGAGACCTGAATAA<br>GTTCCTCAGGGCCCATGGGCCAGATGCAATGATCCTTGTGGATGGAC<br>AGCCACGCCAGGCCAAGGGTGAGCTGGGGCTCTCCCAAATGCTCCA | 171 |

TABLE P-continued

Fusion Sequences.

| Fusion | SEQUENCE | SEQ ID NO |
|---|---|---|
| | CATTGCCAGTCAGATCGCCTCGGGTATGGTGTACCTGGCCTCCCAGC | |
| | ACTTTGTGCACCGAGACCTGGCCACCAGGAACTGCCTGGTTGGAGC | |
| | GAATCTGCTAGTGAAGATTGGGGACTTCGGCATGTCCAGAGATGTCT | |
| | ACAGCACGGATTATTACAGGGTGGGAGGACACACCATGCTCCCCAT | |
| | TCGCTGGATGCCTCCTGAAAGCATCATGTACCGGAAGTTCACTACAG | |
| | AGAGTGATGTATGGAGCTTCGGGGTGATCCTCTGGGAGATCTTCACC | |
| | TATGGAAAGCAGCCATGGTTCCAACTCTCAAACACGGAGGTCATTG | |
| | AGTGCATTACCCAAGGTCGTGTTTTGGAGCGGCCCCGAGTCTGCCCC | |
| | AAAGAGGTGTACGATGTCATGCTGGGGTGCTGGCAGAGGGAACCAC | |
| | AGCAGCGGTTGAACATCAAGGAGATCTACAAAATCCTCCATGCTTTG | |
| | GGGAAGGCCACCCCAATCTACCTGGACATTCTTGGCTAG | |
| RUNX1- | ATGGCTTCAGACAGCATATTTGAGTCATTTCCTTCGTACCCACAGTG | 172 |
| NTRK3 | CTTCATGAGAGAATGCATACTTGGAATGAATCCTTCTAGAGACGTCC | |
| | ACGATGCCAGCACGAGCCGCCGCTTCACGCCGCCTTCCACCGCGCTG | |
| | AGCCCAGGCAAGATGAGCGAGGCGTTGCCGCTGGGCGCCCCGGACG | |
| | CCGGCGCTGCCCTGGCCGGCAAGCTGAGGAGCGGCGACCGCAGCAT | |
| | GGTGGAGGTGCTGGCCGACCACCCGGGCGAGCTGGTGCGCACCGAC | |
| | AGCCCCAACTTCCTCTGCTCCGTGCTGCCTACGCACTGGCGCTGCAA | |
| | CAAGACCCTGCCCATCGCTTTCAAGGTGGTGGCCCTAGGGGATGTTC | |
| | CAGATGGCACTCTGGTCACTGTGATGGCTGGCAATGATGAAAACTA | |
| | CTCGGCTGAGCTGAGAAATGCTACCGCAGCCATGAAGAACCAGGTT | |
| | GCAAGATTTAATGACCTCAGGTTTGTCGGTCGAAGTGGAAGAGACC | |
| | TTCCTGAGATCAGCGTGAGCCACGTCAACCTGACCGTACGAGAGGG | |
| | TGACAACGCTGTTATCACTTGCAATGGCTCTGGATCACCCCTTCCTG | |
| | ATGTGGACTGGATAGTCACTGGGCTGCAGTCCATCAACACTCACCAG | |
| | ACCAATCTGAACTGGACCAATGTTCATGCCATCAACTTGACGCTGGT | |
| | GAATGTGACGAGTGAGGACAATGGCTTCACCCTGACGTGCATTGCA | |
| | GAGAACGTGGTGGGCATGAGCAATGCCAGTGTTGCCCTCACTGTCTA | |
| | CTATCCCCCACGTGTGGTGAGCCTGGAGGAGCCTGAGCTGCGCCTGG | |
| | AGCACTGCATCGAGTTTGTGGTGCGTGGCAACCCCCCACCAACGCTG | |
| | CACTGGCTGCACAATGGGCAGCCTCTGCGGGAGTCCAAGATCATCC | |
| | ATGTGGAATACTACCAAGAGGGAGAGATTTCCGAGGGCTGCCTGCT | |
| | CTTCAACAAGCCCACCCACTACAACAATGGCAACTATACCCTCATTG | |
| | CCAAAAACCCACTGGGCACAGCCAACCAGACCATCAATGGCCACTT | |
| | CCTCAAGGAGCCCTTTCCAGAGAGCACGGATAACTTTATCTTGTTTG | |
| | ACGAAGTGAGTCCCACACCTCCTATCACTGTGACCCACAAACCAGA | |
| | AGAAGACACTTTTGGGGTATCCATAGCAGTTGGACTTGCTGCTTTTG | |
| | CCTGTGTCCTGTTGGTGGTTCTCTTCGTCATGATCAACAAATATGGTC | |
| | GACGGTCCAAATTTGGAATGAAGGGTCCCGTGGCTGTCATCAGTGGT | |
| | GAGGAGGACTCAGCCAGCCCACTGCACCACATCAACCACGGCATCA | |
| | CCACGCCCTCGTCACTGGATGCCGGGCCCGACACTGTGGTCATTGGC | |
| | ATGACTCGCATCCCTGTCATTGAGAACCCCCAGTACTTCCGTCAGGG | |
| | ACACAACTGCCACAAGCCGGACACGTATGTGCAGCACATTAAGAGG | |
| | AGAGACATCGTGCTGAAGCGAGAACTGGGTGAGGGAGCCTTTGGAA | |
| | AGGTCTTCCTGGCCGAGTGCTACAACCTCAGCCCGACCAAGGACAA | |
| | GATGCTTGTGGCTGTGAAGGCCCTGAAGGATCCCACCCTGGCTGCCC | |
| | GGAAGGATTTCCAGAGGGAGGCCGAGCTGCTCACCAACCTGCAGCA | |
| | TGAGCACATTGTCAAGTTCTATGGAGTGTGCGGCGATGGGGACCCCC | |
| | TCATCATGGTCTTTGAATACATGAAGCATGGAGACCTGAATAAGTTC | |
| | CTCAGGGCCCATGGGCCAGATGCAATGATCCTTGTGGATGGACAGC | |
| | CACGCCAGGCCAAGGGTGAGCTGGGGCTCTCCCAAATGCTCCACAT | |
| | TGCCAGTCAGATCGCCTCGGGTATGGTGTACCTGGCCTCCCAGCACT | |
| | TTGTGCACCGAGACCTGGCCACCAGGAACTGCCTGGTTGGAGCGAA | |
| | TCTGCTAGTGAAGATTGGGGACTTCGGCATGTCCAGAGATGTCTACA | |
| | GCACGGATTATTACAGGGTGGGAGGACACACCATGCTCCCCATTCG | |
| | CTGGATGCCTCCTGAAAGCATCATGTACCGGAAGTTCACTACAGAG | |
| | AGTGATGTATGGAGCTTCGGGGTGATCCTCTGGGAGATCTTCACCTA | |
| | TGGAAAGCAGCCATGGTTCCAACTCTCAAACACGGAGGTCATTGAG | |
| | TGCATTACCCAAGGTCGTGTTTTGGAGCGGCCCCGAGTCTGCCCCAA | |
| | AGAGGTGTACGATGTCATGCTGGGGTGCTGGCAGAGGGAACCACAG | |
| | CAGCGGTTGAACATCAAGGAGATCTACAAAATCCTCCATGCTTTGGG | |
| | GAAGGCCACCCCAATCTACCTGGACATTCTTGGCTAG | |
| DLG1- | ATGCCGGTCCGGAAGCAAGATACCCAGAGAGCATTGCACCTTTTGG | 173 |
| NTRK3 | AGGAATATCGTTCAAAACTAAGCCAAACTGAAGACAGACAGCTCAG | |
| | AAGTTCCATAGAACGGGTTATTAACATATTTCAGAGCAACCTCTTTC | |
| | AGGCTTTAATAGATATTCAAGAATTTTATGAAGTGACCTTACTGGAT | |
| | AATCCAAAATGTATAGATCGTTCAAAGCCGTCTGAACCAATTCAACC | |
| | TGTGAATACTTGGGAGATTTCCAGCCTTCCAAGCTCTACTGTGACTT | |
| | CAGAGACACTGCCAAGCAGCCTTAGCCCTAGTGTAGAGAAATACAG | |
| | GTATCAGGATGAAGATACACCTCCTCAAGAGCATATTTCCCCACAAA | |
| | TCACAAATGAAGTGATAGGTCCAGAATTGGTTCATGTCTCAGAGAA | |
| | GAACTTATCAGAGATTGAGAATGTCCATGGATTTGTTTCTCATTCTC | |
| | ATATTTCACCAATAAAGCCAACAGAAGCTGTTCTTCCCTCTCCTCCC | |

TABLE P-continued

| Fusion Sequences. | | |
|---|---|---|
| Fusion | SEQUENCE | SEQ ID NO |
| | ACTGTCCCTGTGATCCCTGTCCTGCCAGTCCCTGCTGAGAATACTGT<br>CATCCTACCCACCATACCACAGGCAAATCCTCCCCCAGTACTGGTCA<br>ACACAGATAGCTTGGAAACACCAACTTACGTTAATGGCACAGATGC<br>AGATTATGAATATGAAGAAATCACACTTGAAAGGGGAAATTCAGGG<br>CTTGGTTTCAGCATTGCAGGAGGTACGGACAACCCACACATTGGAG<br>ATGACTCAAGTATTTTCATTACCAAAATTATCACAGGGGGAGCAGCC<br>GCCCAAGATGGAAGATTGCGGGTCAATGACTGTATATTACGAGTAA<br>ATGAAGTAGATGTTCGTGATGTAACACATAGCAAAGCAGTTGAAGC<br>GTTGAAAGAAGCAGGGTCTATTGTACGCTTGTATGTAAAAAGAAGG<br>AAACCAGTGTCAGAAAAAATAATGGAAATAAAGCTCATTAAAGGTC<br>CTAAAGAGAGCACGGATAACTTTATCTTGTTTGACGAAGTGAGTCCC<br>ACACCTCCTATCACTGTGACCCACAAACCAGAAGAAGACACTTTTGG<br>GGTATCCATAGCAGTTGGACTTGCTGCTTTTGCCTGTGTCCTGTTGGT<br>GGTTCTCTTCGTCATGATCAACAAATATGGTCGACGGTCCAAATTTG<br>GAATGAAGGGTCCCGTGGCTGTCATCAGTGGTGAGGAGGACTCAGC<br>CAGCCCACTGCACCACATCAACCACGGCATCACCACGCCCTCGTCAC<br>TGGATGCCGGGCCCGACACTGTGGTCATTGGCATGACTCGCATCCCT<br>GTCATTGAGAACCCCCAGTACTTCCGTCAGGGACACAACTGCCACA<br>AGCCGGACACGTATGTGCAGCACATTAAGAGGAGAGACATCGTGCT<br>GAAGCGAGAACTGGGTGAGGGAGCCTTTGGAAAGGTCTTCCTGGCC<br>GAGTGCTACAACCTCAGCCCGACCAAGGACAAGATGCTTGTGGCTG<br>TGAAGGCCCTGAAGGATCCCACCCTGGCTGCCCGGAAGGATTTCCA<br>GAGGGAGGCCGAGCTGCTCACCAACCTGCAGCATGAGCACATTGTC<br>AAGTTCTATGGAGTGTGCGGCGATGGGGACCCCCTCATCATGGTCTT<br>TGAATACATGAAGCATGGAGACCTGAATAAGTTCCTCAGGGCCCAT<br>GGGCCAGATGCAATGATCCTTGTGGATGGACAGCCACGCCAGGCCA<br>AGGGTGAGCTGGGGCTCTCCCAAATGCTCCACATTGCCAGTCAGATC<br>GCCTCGGGTATGGTGTACCTGGCCTCCCAGCACTTTGTGCACCGAGA<br>CCTGGCCACCAGGAACTGCCTGGTTGGAGCGAATCTGCTAGTGAAG<br>ATTGGGGACTTCGGCATGTCCAGAGATGTCTACAGCACGGATTATTA<br>CAGGGTGGGAGGACACACCATGCTCCCCATTCGCTGGATGCCTCCTG<br>AAAGCATCATGTACCGGAAGTTCACTACAGAGAGTGATGTATGGAG<br>CTTCGGGGTGATCCTCTGGGAGATCTTCACCTATGGAAAGCAGCCAT<br>GGTTCCAACTCTCAAACACGGAGGTCATTGAGTGCATTACCCAAGGT<br>CGTGTTTTGGAGCGGCCCCGAGTCTGCCCCAAAGAGGTGTACGATGT<br>CATGCTGGGGTGCTGGCAGAGGGAACCACAGCAGCGGTTGAACATC<br>AAGGAGATCTACAAAATCCTCCATGCTTTGGGGAAGGCCACCCCAA<br>TCTACCTGGACATTCTTGGCTAG | |
| AMMECR1-NTRK3 | ATGGCGGCGGGTTGCTGCGGGGTGAAGAAGCAGAAACTGTCCAGTT<br>CGCCCCCCTCTGGCTCGGGTGGCGGTGGTGGCGCCTCCTCCTCCTCC<br>CACTGCAGCGGAGAGAGCCAGTGCCGAGCTGGGGAGCTGGGACTAG<br>GAGGCGCCGGTACGCGGCTCAACGGGCTGGGAGGTCTAACCGGAGG<br>AGGTAGCGGCAGCGGCTGTACCCTCTCTCCCCCCCAGGGCTGCGGCG<br>GCGGCGGCGGGGGGATCGCCCTGTCGCCACCTCCGAGCTGCGGAGT<br>GGGGACCCTACTTTCTACCCCGGCCGCCGCCACCTCTTCCTCACCCT<br>CCTCATCGTCCGCCGCCTCGTCCTCATCGCCGGGCTCCCGGAAGATG<br>GTGGTGTCAGCAGAGATGTGCTGCTTTTGCTTCGATGTGCTCTACTG<br>TCACCTGTATGGATACCAGCAGCCCCGGACCCCCCGATTCACCAACG<br>AGCCCTACCCACTGTTTGTAACATGGAAGATTGGTCGAGACAAAAG<br>ATTACGTGGATGCATAGGTACTTTTTCTGCCATGAATTTGCATTCAG<br>GACTCAGGGAGTACACACTTACCAGAAACCTGTCAAGTAACCGGCT<br>CACCACACTCTCGTGGCAGCTCTTCCAGACGCTGAGTCTTCGGGAAT<br>TGCAGTTGGAGCAGAACTTTTTCAACTGCAGCTGTGACATCCGCTGG<br>ATGCAGCTCTGGCAGGAGCAGGGGGAGGCCAAGCTCAACAGCCAGA<br>ACCTCTACTGCATCAACGCTGATGGCTCCCAGCTTCCTCTCTTCCGCA<br>TGAACATCAGTCAGTGTGACCTTCCTGAGATCAGCGTGAGCCACGTC<br>AACCTGACCGTACGAGAGGGTGACAACGCTGTTATCACTTGCAATG<br>GCTCTGGATCACCCCTTCCTGATGTGGACTGGATAGTCACTGGGCTG<br>CAGTCCATCAACACTCACCAGACCAATCTGAACTGGACCAATGTTCA<br>TGCCATCAACTTGACGCTGGTGAATGTGACGAGTGAGGACAATGGC<br>TTCACCCTGACGTGCATTGCAGAGAACGTGGTGGGCATGAGCAATG<br>CCAGTGTTGCCCTCACTGTCTACTATCCCCCACGTGTGGTGAGCCTG<br>GAGGAGCCTGAGCTGCGCCTGGAGCACTGCATCGAGTTTGTGGTGC<br>GTGGCAACCCCCCACCAACGCTGCACTGGCTGCACAATGGGCAGCC<br>TCTGCGGGAGTCCAAGATCATCCATGTGGAATACTACCAAGAGGGA<br>GAGATTTCCGAGGGCTGCCTGCTCTTCAACAAGCCCACCCACTACAA<br>CAATGGCAACTATACCCTCATTGCCAAAAACCCACTGGGCACAGCC<br>AACCAGACCATCAATGGCCACTTCCTCAAGGAGCCCTTTCCAGAGA<br>GCACGGATAACTTTATCTTGTTTGACGAAGTGAGTCCCACACCTCCT<br>ATCACTGTGACCCACAAACCAGAAGAAGACACTTTTGGGGTATCCA<br>TAGCAGTTGGACTTGCTGCTTTTGCCTGTGTCCTGTTGGTGGTTCTCT<br>TCGTCATGATCAACAAATATGGTCGACGGTCCAAATTTGGAATGAA<br>GGGTCCCGTGGCTGTCATCAGTGGTGAGGAGGACTCAGCCAGCCCA<br>CTGCACCACATCAACCACGGCATCACCACGCCCTCGTCACTGGATGC | 174 |

TABLE P-continued

| Fusion Sequences. | | |
|---|---|---|
| Fusion | SEQUENCE | SEQ ID NO |
| | CGGGCCCGACACTGTGGTCATTGGCATGACTCGCATCCCTGTCATTG AGAACCCCCAGTACTTCCGTCAGGGACACAACTGCCACAAGCCGGA CACGTATGTGCAGCACATTAAGAGGAGAGACATCGTGCTGAAGCGA GAACTGGGTGAGGGAGCCTTTGGAAAGGTCTTCCTGGCCGAGTGCT ACAACCTCAGCCCGACCAAGGACAAGATGCTTGTGGCTGTGAAGGC CCTGAAGGATCCCACCCTGGCTGCCCGGAAGGATTTCCAGAGGGAG GCCGAGCTGCTCACCAACCTGCAGCATGAGCACATTGTCAAGTTCTA TGGAGTGTGCGGCGATGGGGACCCCCTCATCATGGTCTTTGAATACA TGAAGCATGGAGACCTGAATAAGTTCCTCAGGGCCCATGGGCCAGA TGCAATGATCCTTGTGGATGGACAGCCACGCCAGGCCAAGGGTGAG CTGGGGCTCTCCCAAATGCTCCACATTGCCAGTCAGATCGCCTCGGG TATGGTGTACCTGGCCTCCCAGCACTTTGTGCACCGAGACCTGGCCA CCAGGAACTGCCTGGTTGGAGCGAATCTGCTAGTGAAGATTGGGGA CTTCGGCATGTCCAGAGATGTCTACAGCACGGATTATTACAGGGTGG GAGGACACACCATGCTCCCCATTCGCTGGATGCCTCCTGAAAGCATC ATGTACCGGAAGTTCACTACAGAGAGTGATGTATGGAGCTTCGGGG TGATCCTCTGGGAGATCTTCACCTATGGAAAGCAGCCATGGTTCCAA CTCTCAAACACGGAGGTCATTGAGTGCATTACCCAAGGTCGTGTTTT GGAGCGGCCCCGAGTCTGCCCCAAAGAGGTGTACGATGTCATGCTG GGGTGCTGGCAGAGGGAACCACAGCAGCGGTTGAACATCAAGGAG ATCTACAAAATCCTCCATGCTTTGGGGAAGGCCACCCCAATCTACCT GGACATTCTTGGCTAG | |
| TNRC6A-NTRK3 | ATGAGAGAATTGGAAGCTAAAGCTACCAAAGACGTAGAAAGAAATC TTAGCAGGGATTTAGTGCAAGAAGAAGAACAGTTGATGGAAGAAAA GAAAAAGAAAAAAGACGACAAGAAAAAGAAGGAAGCTGCTCAAAA GAAGGCCACTGAACAAAAAATCAAAGATGTGCAGCACATTAAGAGG AGAGACATCGTGCTGAAGCGAGAACTGGGTGAGGGAGCCTTTGGAA AGGTCTTCCTGGCCGAGTGCTACAACCTCAGCCCGACCAAGGACAA GATGCTTGTGGCTGTGAAGGCCCTGAAGGATCCCACCCTGGCTGCCC GGAAGGATTTCCAGAGGGAGGCCGAGCTGCTCACCAACCTGCAGCA TGAGCACATTGTCAAGTTCTATGGAGTGTGCGGCGATGGGGACCCCC TCATCATGGTCTTTGAATACATGAAGCATGGAGACCTGAATAAGTTC CTCAGGGCCCATGGGCCAGATGCAATGATCCTTGTGGATGGACAGC CACGCCAGGCCAAGGGTGAGCTGGGGCTCTCCCAAATGCTCCACAT TGCCAGTCAGATCGCCTCGGGTATGGTGTACCTGGCCTCCCAGCACT TTGTGCACCGAGACCTGGCCACCAGGAACTGCCTGGTTGGAGCGAA TCTGCTAGTGAAGATTGGGGACTTCGGCATGTCCAGAGATGTCTACA GCACGGATTATTACAGGGTGGGAGGACACACCATGCTCCCCATTCG CTGGATGCCTCCTGAAAGCATCATGTACCGGAAGTTCACTACAGAG AGTGATGTATGGAGCTTCGGGGTGATCCTCTGGGAGATCTTCACCTA TGGAAAGCAGCCATGGTTCCAACTCTCAAACACGGAGGTCATTGAG TGCATTACCCAAGGTCGTGTTTTGGAGCGGCCCCGAGTCTGCCCCAA AGAGGTGTACGATGTCATGCTGGGGTGCTGGCAGAGGGAACCACAG CAGCGGTTGAACATCAAGGAGATCTACAAAATCCTCCATGCTTTGGG GAAGGCCACCCCAATCTACCTGGACATTCTTGGCTAG | 175 |
| IQGAP1-NTRK3 | ATGTCCGCCGCAGACGAGGTTGACGGGCTGGGCGTGGCCCGGCCGC ACTATGGCTCTGTCCTGGATAATGAAAGACTTACTGCAGAGGAGAT GGATGAAAGGAGACGTCAGAACGTGGCTTATGAGTACCTTTGTCATT TGGAAGAAGCGAAGAGGTGGATGGAAGCATGCCTAGGGGAAGATC TGCCTCCCACCACAGAACTGGAGGAGGGGCTTAGGAATGGGGTCTA CCTTGCCAAACTGGGGAACTTCTTCTCTCCCAAAGTAGTGTCCCTGA AAAAAATCTATGATCGAGAACAGACCAGATACAAGGCGACTGGCCT CCACTTTAGACACACTGATAATGTGATTCAGTGGTTGAATGCCATGG ATGAGATTGGATTGCCTAAGATTTTTTACCCAGAAACTACAGATATC TATGATCGAAAGAACATGCCAAGATGTATCTACTGTATCCATGCACT CAGTTTGTACCTGTTCAAGCTAGGCCTGGCCCCTCAGATTCAAGACC TATATGGAAAGGTTGACTTCACAGAAGAAGAAATCAACAACATGAA GACTGAGTTGGAGAAGTATGGCATCCAGATGCCTGCCTTTAGCAAG ATTGGGGGCATCTTGGCTAATGAACTGTCAGTGGATGAAGCCGCATT ACATGCTGCTGTTATTGCTATTAATGAAGCTATTGACCGTAGAATTC CAGCCGACACATTTGCAGCTTTGAAAAATCCGAATGCCATGCTTGTA AATCTTGAAGAGCCCTTGGCATCCACTTACCAGGATATACTTTACCA GGCTAAGCAGGACAAAATGACAAATGCTAAAAACAGGACAGAAAA CTCAGAGAGAGAAAGAGATGTTTATGAGGAGCTGCTCACGCAAGCT GAAATTCAAGGCAATATAAACAAAGTCAATAAGAGCACGGATAACT TTATCTTGTTTGACGAAGTGAGTCCCACACCTCCTATCACTGTGACC CACAAACCAGAAGAAGACACTTTTGGGGTATCCATAGCAGTTGGAC TTGCTGCTTTTGCCTGTGTCCTGTTGGTGGTTCTCTTCGTCATGATCA ACAAATATGGTCGACGGTCCAAATTTGGAATGAAGGGTCCCGTGGC TGTCATCAGTGGTGAGGAGGACTCAGCCAGCCCACTGCACCACATC AACCACGGCATCACCACGCCCTCGTCACTGGATGCCGGGCCCGACA CTGTGGTCATTGGCATGACTCGCATCCCTGTCATTGAGAACCCCCAG TACTTCCGTCAGGGACACAACTGCCACAAGCCGGACACGTATGTGC | 176 |

TABLE P-continued

Fusion Sequences.

| Fusion | SEQUENCE | | SEQ ID NO |
|---|---|---|---|
| | AGCACATTAAGAGGAGAGACATCGTGCTGAAGCGAGAACTGGGTGA | | |
| | GGGAGCCTTTGGAAAGGTCTTCCTGGCCGAGTGCTACAACCTCAGCC | | |
| | CGACCAAGGACAAGATGCTTGTGGCTGTGAAGGCCCTGAAGGATCC | | |
| | CACCCTGGCTGCCCGGAAGGATTTCCAGAGGGAGGCCGAGCTGCTC | | |
| | ACCAACCTGCAGCATGAGCACATTGTCAAGTTCTATGGAGTGTGCGG | | |
| | CGATGGGGACCCCCTCATCATGGTCTTTGAATACATGAAGCATGGAG | | |
| | ACCTGAATAAGTTCCTCAGGGCCCATGGGCCAGATGCAATGATCCTT | | |
| | GTGGATGGACAGCCACGCCAGGCCAAGGGTGAGCTGGGGCTCTCCC | | |
| | AAATGCTCCACATTGCCAGTCAGATCGCCTCGGGTATGGTGTACCTG | | |
| | GCCTCCCAGCACTTTGTGCACCGAGACCTGGCCACCAGGAACTGCCT | | |
| | GGTTGGAGCGAATCTGCTAGTGAAGATTGGGGACTTCGGCATGTCC | | |
| | AGAGATGTCTACAGCACGGATTATTACAGGGTGGGAGGACACACCA | | |
| | TGCTCCCCATTCGCTGGATGCCTCCTGAAAGCATCATGTACCGGAAG | | |
| | TTCACTACAGAGAGTGATGTATGGAGCTTCGGGGTGATCCTCTGGGA | | |
| | GATCTTCACCTATGGAAAGCAGCCATGGTTCCAACTCTCAAACACGG | | |
| | AGGTCATTGAGTGCATTACCCAAGGTCGTGTTTTGGAGCGGCCCCGA | | |
| | GTCTGCCCCAAAGAGGTGTACGATGTCATGCTGGGGTGCTGGCAGA | | |
| | GGGAACCACAGCAGCGGTTGAACATCAAGGAGATCTACAAAATCCT | | |
| | CCATGCTTTGGGGAAGGCCACCCCAATCTACCTGGACATTCTTGGCT | | |
| | AG | | |
| CARM1- | atggcagcgg cggcggcggc ggtggggccg ggcgcgggcg gcgcggggtc ggcggtcccg | 60 | 11 |
| NTRK3 | ggcggcgcgg ggccctgcgc taccgtgtcg gtgttccccg gcgcccgcct cctcaccatc | 120 | |
| | ggcgacgcga acggcgagat ccagcggcac gcggagcagc aggcgctgcg cctcgaggtg | 180 | |
| | cgcgccggcc cggactcggc gggcatcgcc ctctacagcc atgaagatgt gtgtgtcttt | 240 | |
| | aagtgctcag tgtcccgaga gacagagtgc agccgtgtgg gcaagcagtc cttcatcatc | 300 | |
| | accctgggct gcaacagcgt cctcatccag ttcgccacac ccaacgattt ctgttccttc | 360 | |
| | tacaacatcc tgaaaacctg ccggggccac accctggagc ggtctgtgtt cagcgagcgg | 420 | |
| | acggaggagt cttctgccgt gcagtacttc cagaagcagc gatcggagat ggatgtctct | 480 | |
| | ctttgcccag ccaagtgtag tttctggcgg attttcttgc tgggaagcgt ctggctggac | 540 | |
| | tatgtgggct ccgtgctggc ttgccctgca aattgtgtct gcagcaagac tgagatcaat | 600 | |
| | tgccggcggc cggacgatgg gaacctcttc cccctcctgg aagggcagga ttcagggaac | 660 | |
| | agcaatggga acgccagtat caacatcacg gacatctcaa ggaatatcac ttccatacac | 720 | |
| | atagagaact ggcgcagtct tcacacgctc aacgccgtgg acatggagct ctacaccgga | 780 | |
| | cttcaaaagc tgaccatcaa gaactcagga cttcggagca ttcagcccag agcctttgcc | 840 | |
| | aagaaccccc atttgcgtta tataaacctg tcaagtaacc ggctcaccac actctcgtgg | 900 | |
| | cagctcttcc agacgctgag tcttcgggaa ttgcagttgg agcagaactt tttcaactgc | 960 | |
| | agctgtgaca tccgctggat gcagctctgg caggagcagg gggaggccaa gctcaacagc | 1020 | |
| | cagaacctct actgcatcaa cgctgatggc tcccagcttc ctctcttccg catgaacatc | 1080 | |
| | agtcagtgtg accttcctga gatcagcgtg agccacgtca acctgaccgt acgagagggt | 1140 | |
| | gacaatgctg ttatcacttg caatggctct ggatcacccc ttcctgatgt ggactggata | 1200 | |
| | gtcactgggc tgcagtccat caacactcac cagaccaatc tgaactggac caatgttcat | 1260 | |
| | gccatcaact tgacgctggt gaatgtgacg agtgaggaca atggcttcac cctgacgtgc | 1320 | |
| | attgcagaga acgtggtggg catgagcaat gccagtgttg ccctcactgt ctactatccc | 1380 | |
| | ccacgtgtgg tgagcctgga ggagcctgag ctgcgcctgg agcactgcat cgagtttgtg | 1440 | |
| | gtgcgtggca accccccacc aacgctgcac tggctgcaca atgggcagcc tctgcgggag | 1500 | |
| | tccaagatca tccatgtgga atactaccaa gagggagaga tttccgaggg ctgcctgctc | 1560 | |
| | ttcaacaagc ccacccacta caacaatggc aactataccc tcattgccaa aaacccactg | 1620 | |
| | ggcacagcca accagaccat caatggccac ttcctcaagg agccctttcc agagagcacg | 1680 | |
| | gataacttta tcttgtttga cgaagtgagt cccacacctc ctatcactgt gacccacaaa | 1740 | |
| | ccagaagaag acacttttgg ggtatccata gcagttggac ttgctgcttt tgcctgtgtc | 1800 | |
| | ctgttggtgg ttctcttcgt catgatcaac aaatatggtc gacggtccaa atttggaatg | 1860 | |
| | aagggtcccg tggctgtcat cagtggtgag gaggactcag ccagcccact gcaccacatc | 1920 | |
| | aaccacggca tcaccacgcc ctcgtcactg gatgccgggc ccgacactgt ggtcattggc | 1980 | |
| | atgactcgca tccctgtcat tgagaacccc cagtacttcc gtcagggaca caactgccac | 2040 | |
| | aagccggaca cgtatgtgca gcacattaag aggagagaca tcgtgctgaa gcgagaactg | 2100 | |
| | ggtgagggag cctttggaaa ggtcttcctg gccgagtgct acaacctcag cccgaccaag | 2160 | |
| | gacaagatgc ttgtggctgt gaaggccctg aaggatccca ccctggctgc ccggaaggat | 2220 | |
| | ttccagaggg aggccgagct gctcaccaac ctgcagcatg agcacattgt caagttctat | 2280 | |
| | ggagtgtgcg gcgatgggga cccccctcatc atggtctttg aatacatgaa gcatggagac | 2340 | |
| | ctgaataagt tcctcagggc ccatgggcca gatgcaatga tccttgtgga tggacagcca | 2400 | |
| | cgccaggcca agggtgagct ggggctctcc caaatgctcc acattgccag tcagatcgcc | 2460 | |
| | tcgggtatgg tgtacctggc ctcccagcac tttgtgcacc gagacctggc caccaggaac | 2520 | |
| | tgcctggttg gagcgaatct gctagtgaag attggggact tcggcatgtc cagagatgtc | 2580 | |
| | tacagcacgg attattacag ggtgggagga cacaccatgc tccccattcg ctggatgcct | 2640 | |
| | cctgaaagca tcatgtaccg gaagttcact acagagagtg atgtatggag cttcggggtg | 2700 | |
| | atcctctggg agatcttcac ctatggaaag cagccatggt tccaactctc aaacacggag | 2760 | |
| | gtcattgagt gcattaccca aggtcgtgtt ttggagcggc cccgagtctg ccccaaagag | 2820 | |
| | gtgtacgatg tcatgctggg gtgctggcag agggaaccac agcagcggtt gaacatcaag | 2880 | |
| | gagatctaca aaatcctcca tgctttgggg aaggccaccc caatctacct ggacattctt | 2940 | |
| | ggctag | | |

TABLE P-continued

Fusion Sequences.

| Fusion | SEQUENCE | SEQ ID NO |
|---|---|---|
| | Fusion Amino Acid Sequences | |
| KIRREL-NTRK1 | MLSLLVWILTLSDTFSQGTQTRFSQEPADQTVVAGQRAVLPCVLLNYS<br>GIVQWTKDGLALGMGQGLKAWPRYRVVGSADAGQYNLEITDAELSD<br>DASYECQATEAALRSRRAKLTVLIPASVQLHTAVEMEIHWCIPFSVDGQ<br>PAPSLRWLFNGSVLNETSFIFTEFLEPAANETVRHGCLRLNQPTHVNNG<br>NYTLLAANPFGQASASIMAAFMDNPFEFNPEDPIPVSFSPVDTNSTSGDP<br>VEKKDETPFGVSVAVGLAVFACLFLSTLLLVLNKCGRRNKFGINRPAVL<br>APEDGLAMSLHFMTLGGSSLSPTEGKGSGLQGHIIENPQYFSDACVEIHI<br>KRRDIVLKWELGEGAFGKVFLAECHNLLPEQDKMLVAVKALKEASES<br>ARQDFQREAELLTMLQHQHIVRFFGVCTEGRPLLMVFEYMRHGDLNRF<br>LRSHGPDAKLLAGGEDVAPGPLGLGQLLAVASQVAAGMVYLAGLHFV<br>HRDLATRNCLVGQGLVVKIGDFGMSRDIYSTDYYRVGGRTMLPIRWM<br>PPESILYRKFTTESDVWSFGVVLWEIFTYGKQPWYQLSNTEAIDCITQGR<br>ELERPRACPPEVYAIMRGCWQREPQQRHSIKDVHARLQALAQAPPVYL<br>DVLG | 81 |
| KIRREL-NTRK1 | MLSLLVWILTLSDTFSQGTQTRFSQEPADQTVVAGQRAVLPCVLLNYS<br>GIVQWTKDGLALGMGQGLKAWPRYRVVGSADAGQYNLEITDAELSD<br>DASYECQATEAALRSRRAKLTVLIPPEDTRIDGGPVILLQAGTPHNLTCR<br>AFNAKPAATIIWFRDGTQQEGAVASTELLKDGKRETTVSQLLINPTDLDI<br>GRVFTCRSMNEAIPSGKETSIELDVEIHPPTVTLSIEPQTVQEGERVVFTC<br>QATANPEILGYRWAKGGFLIEDAHESRYETNVDYSFFTEPVSCEVHNKV<br>GSTNVSTLVNVHFAPRIVVDPKPTTTDIGSDVTLTCVWVGNPPLTLTWT<br>KKDSNMVLSNSNQLLLKSVTQADAGTYTCRAIVPRIGVAEREVPLYVN<br>GPPIISSEAVQYAVRGDGGKVECFIGSTPPPDRIAWAWKENFLEVGTLER<br>YTVERTNSGSGVLSTLTINNVMEADFQTHYNCTAWNSFGPGTAIIQLEE<br>RDTNSTSGDPVEKKDETPFGVSVAVGLAVFACLFLSTLLLVLNKCGRR<br>NKFGINRPAVLAPEDGLAMSLHFMTLGGSSLSPTEGKGSGLQGHIIENP<br>QYFSDACVEIHIKRRDIVLKWELGEGAFGKVFLAECHNLLPEQDKMLVA<br>VKALKEASESARQDFQREAELLTMLQHQHIVRFFGVCTEGRPLLMVFE<br>YMRHGDLNRFLRSHGPDAKLLAGGEDVAPGPLGLGQLLAVASQVAAG<br>MVYLAGLHFVHRDLATRNCLVGQGLVVKIGDFGMSRDIYSTDYYRVG<br>GRTMLPIRWMPPESILYRKFTTESDVWSFGVVLWEIFTYGKQPWYQLS<br>NTEAIDCITQGRELERPRACPPEVYAIMRGCWQREPQQRHSIKDVHARL<br>QALAQAPPVYLDVLG | 82 |
| CCDC88C-NTRK1 | MDVTVSELLELFLQSPLVTWVKTFGPFGSGSQDNLTMYMDLVDGIFLN<br>QIMLQIDPRPTNQRINKHVNNDVNLRIQNLTILVRNIKTYYQEVLQQLIV<br>MNLPNVLMIGRDPLSGKSMEEIKKVLLLVLGCAVQCERKEEFIERIKQL<br>DIETQAGIVAHIQEVTHNQENVFDLQWLELPDVAPEELEALSRSMVLHL<br>RRLIDQRDECTELIVDLTQERDYLQAQHPPSPIKSSSADSTPSPTSSLSSE<br>DKQHLAVELADTKARLRRVRQELEDKTEQLVDTRHEVDQLVLELQKV<br>KQENIQLAADARSARAYRDELDSLREKANRVERLELELTRCKEKLHDV<br>DFYKARMEELREDNIILIETKAMLEEQLTAARARGDKVHELEKENLQL<br>KSKLHDLELDRDTDKKRIEELLEENMVLEIAQKQSMNESAHLGWELEQ<br>LSKNADLSDGPAVLAPEDGLAMSLHFMTLGGSSLSPTEGKGSGLQGHII<br>ENPQYFSDACVHHIKRRDIVLKWELGEGAFGKVFLAECHNLLPEQDKM<br>LVAVKALKEASESARQDFQREAELLTMLQHQHIVRFFGVCTEGRPLLM<br>VFEYMRHGDLNRFLRSHGPDAKLLAGGEDVAPGPLGLGQLLAVASQV<br>AAGMVYLAGLHFVHRDLATRNCLVGQGLVVKIGDFGMSRDIYSTDYY<br>RVGGRTMLPIRWMPPESILYRKFTTESDVWSFGVVLWEIFTYGKQPWY<br>QLSNTEAIDCITQGRELERPRACPPEVYAIMRGCWQREPQQRHSIKDVH<br>ARLQALAQAPPVYLDVLG | 83 |
| DCTN1-NTRK1 | MAQSKRHVYSRTPSGSRMSAEASARPLRVGSRVEVIGKGHRGTVAYV<br>GATLFATGKWVGVILDEAKGKNDGTVQGRKYFTCDEGHGIFVRQSQIQ<br>VFEDGADTTSPETPDSSASKVLKREGTDTTAKTSKLRGLKPKKAPTARK<br>TTTRRPKPTRPASTGVAGASSSLGPSGSASAGELSSSEPSTPAQTPLAAPII<br>PTPVLTSPGAVPPLPSPSKEEEGLRAQVRDLEEKLETLRLKRAEDKAKL<br>KELEKHKIQLEQVQEWKSKMQEQQADLQRRLKEARKEAKEALEAKER<br>YMEEMADTADAIEMATLDKEMAEERAESLQQEVEALKERVDELTTDL<br>EILKAEIEEKGSDGAASSYQLKQLEEQNARLKDALVRMRDLSSSEKQEH<br>VKLQKLMEKKNQELEVVRQQRERLQEELSQAESTIDELKEQVDAALGA<br>EEMVEMLTDRNLNLEEKVRELRETVGDLEAMNEMNDELQENARETEL<br>ELREQLDMAGARVREAQKRVEAAQETVADYQQTIKKYRQLTAHLQDV<br>NRELTNQQEASVERQQQPPPETFDFKIKFAETKAHAKAIEMELRQMEV<br>AQANRHMSLLTAFMPDSFLRPGGDHDCVLVLLLMPRLICKAELIRKQA<br>QEKFELSENCSERPGLRGAAGEQLSFAAGLVYSLSLLQATLHRYEHALS<br>QCSVDVYKKVGSLYPEMSAHERSLDFLIELLHKDQLDETVNVEPLTKAI<br>KYYQHLYSIHLAEQPEDCTMQLADHIKFTQSALDCMSVEVGRLRAFLQ<br>GGQEATDIALLLRDLETSCSDIRQFCKKIRRRMPGTDAPGIPAALAFGPQ<br>VSDTLLDCRKHLTWVVAVLQEVAAAAAQLIAPLAENEGLLVAALEEL<br>AFKASEQIYGTPSSSPYECLRQSCNILISTMNKLATAMQEGEYDAERPPS | 84 |

TABLE P-continued

Fusion Sequences.

| Fusion | SEQUENCE | SEQ ID NO |
|---|---|---|
| | KPPPVELRAAALRAEITDAEGLGLKLEDRETVIKELKKSLKIKGEELSEA NVRLSLLEKKLDSAAKDADERIEKVQTRLEETQALLRKKEKEFEETMD ALQADIDQLEAEKAELKQRLNSQSKRTIEGLRGPPPSGIATLVSGIAGGP AVLAPEDGLAMSLHFMTLGGSSLSPTEGKGSGLQGHIIENPQYFSDACV HHIKRRDIVLKWELGEGAFGKVFLAECHNLLPEQDKMLVAVKALKEAS ESARQDFQREAELLTMLQHQHIVRFFGVCTEGRPLLMVFEYMRHGDLN RFLRSHGPDAKLLAGGEDVAPGPLGLGQLLAVASQVAAGMVYLAGLH FVHRDLATRNCLVGQGLVVKIGDFGMSRDIYSTDYYRVGGRTMLPIRW MPPESILYRKFTTESDVWSFGVVLWEIFTYGKQPWYQLSNTEAIDCITQ GRELERPRACPPEVYAIMRGCWQREPQQRHSIKDVHARLQALAQAPPV YLDVLG | |
| EML4-NTRK1 | MDGFAGSLDDSISAASTSDVQDRLSALESRVQQQEDEITVLKAALADVL RRLAISEDHVASVKKSVSSKGQPSPRAVIPMSCITNGSGANRKPSHTSAV SIAGKETLSSAAKSGTEKKKEKPQGQREKKEESHSNDQSPQIRASPSPQP SSQPLQIHRQTPESKNATPTKSIKRPSPAEKSHNSWENSDDSRNKLSKIPS TPKLIPKVTKTADKHKDVIINQEGEYIKMFMRGRPITMFIPSDVDNYDDI RTELPPEKLKLEWAYGYRGKDCRANVYLLPTGKIVYFIASVVVLFNYE ERTQRHYLGHTDCVKCLAIHPDKIRIATGQIAGVDKDGRPLQPHVRVW DSVTLSTLQIIGLGTFERGVGCLDFSKADSGVHLCIIDDSNEHMLTVWD WQKKAKGAEIKTTNEVVLAVEFHPTDANTIITCGKSHIFFWTWSGNSLT RKQGIFGKYEKPKFVQCLAFLGNGDVLTGDSGGVMLIWSKTTVEPTPG KGPKGVYQISKQIKAHDGSVFTLCQMRNGMLLTGGGKDRKIILWDHDL NPEREIEVPDQYGTIRAVAEGKADQFLVGTSRNFILRGTFNDGFQIEVQG HTDELWGLATHPFKDLLLTCAQDRQVCLWNSMEHRLEWTRLVDEPGH CADFHPSGTVVAIGTHSGRWFVLDAETRDLVSIHTDGNEQLSVMRYSIG PAVLAPEDGLAMSLHFMTLGGSSLSPTEGKGSGLQGHIIENPQYFSDAC VHHIKRRDIVLKWELGEGAFGKVFLAECHNLLPEQDKMLVAVKALKE ASESARQDFQREAELLTMLQHQHIVRFFGVCTEGRPLLMVFEYMRHGD LNRFLRSHGPDAKLLAGGEDVAPGPLGLGQLLAVASQVAAGMVYLAG LHFVHRDLATRNCLVGQGLVVKIGDFGMSRDIYSTDYYRVGGRTMLPI RWMPPESILYRKFTTESDVWSFGVVLWEIFTYGKQPWYQLSNTEAIDCI TQGRELERPRACPPEVYAIMRGCWQREPQQRHSIKDVHARLQALAQAP PVYLDVLG | 85 |
| PRKAR1A-NTRK1 | MESGSTAASEEARSLRECELYVQKHNIQALLKDSIVQLCTARPERPMAF LREYFERLEKEEAKQIQNLQKAGTRTDSREDEISPPPPNPVVKGRRRRG AISAEVYTEEDAASYVRKVIPKDYKTMAALAKAIEKNVLFSHLDDNER SDIFDAMFSVSFIAGETVIQQGDEGDNFYVIDQGETDVYVNNEWATSVG EGGSFGELALIYGTPRAATVKAKTNVKLWGIDRDSYRRILMGSTLRKR KMYEEFLSKVSILGPAVLAPEDGLAMSLHFMTLGGSSLSPTEGKGSGLQ GHIIENPQYFSDACVHHIKRRDIVLKWELGEGAFGKVFLAECHNLLPEQ DKMLVAVKALKEASESARQDFQREAELLTMLQHQHIVRFFGVCTEGRP LLMVFEYMRHGDLNRFLRSHGPDAKLLAGGEDVAPGPLGLGQLLAVA SQVAAGMVYLAGLHFVHRDLATRNCLVGQGLVVKIGDFGMSRDIYST DYYRVGGRTMLPIRWMPPESILYRKFTTESDVWSFGVVLWEIFTYGKQ PWYQLSNTEAIDCITQGRELERPRACPPEVYAIMRGCWQREPQQRHSIK DVHARLQALAQAPPVYLDVLG | 86 |
| PTPRC-NTRK1 | MTMYLWLKLLAFGFAFLDTEVFVTVPASVQLHTAVEMHHWCIPFSVD GQPAPSLRWLFNGSVLNETSFIFTEFLEPAANETVRHGCLRLNQPTHVN NGNYTLLAANPFGQASASIMAAFMDNPFEFNPEDPIPVSFSPVDTNSTSG DPVEKKDETPFGVSVAVGLAVFACLFLSTLLLVLNKCGRRNKFGINRPA VLAPEDGLAMSLHFMTLGGSSLSPTEGKGSGLQGHIIENPQYFSDACVH HIKRRDIVLKWELGEGAFGKVFLAECHNLLPEQDKMLVAVKALKEASE SARQDFQREAELLTMLQHQHIVRFFGVCTEGRPLLMVFEYMRHGDLNR FLRSHGPDAKLLAGGEDVAPGPLGLGQLLAVASQVAAGMVYLAGLHF VHRDLATRNCLVGQGLVVKIGDFGMSRDIYSTDYYRVGGRTMLPIRW MPPESILYRKFTTESDVWSFGVVLWEIFTYGKQPWYQLSNTEAIDCITQ GRELERPRACPPEVYAIMRGCWQREPQQRHSIKDVHARLQALAQAPPV YLDVLG | 87 |
| ARGLU1-NTRK1 | MGRSRSRSSSRSKHTKSSKHNKKRSRSRSRSRDKERVRKRSKSRESKRN RRRESRSRSRSTNTAVSRRERDRERASSPPDRIDIFGRTVSKRSSLDEKQ KREEEEKKAEFERQRKIRQQEIEEKLIEEETARRVEELVAKRVEEELEKR KDEIEREVLRRVEEAKRIMEKQLLEELERQRQAELAAQKAREEEERAK REELERILEENNRKIAEAQAKLVSVAVGLAVFACLFLSTLLLVLNKCGR RNKFGINRPAVLAPEDGLAMSLHFMTLGGSSLSPTEGKGSGLQGHIIENP QYFSDACVHHIKRRDIVLKWELGEGAFGKVFLAECHNLLPEQDKMLVA VKALKEASESARQDFQREAELLTMLQHQHIVRFFGVCTEGRPLLMVFE YMRHGDLNRFLRSHGPDAKLLAGGEDVAPGPLGLGQLLAVASQVAAG MVYLAGLHFVHRDLATRNCLVGQGLVVKIGDFGMSRDIYSTDYYRVG GRTMLPIRWMPPESILYRKFTTESDVWSFGVVLWEIFTYGKQPWYQLS NTEAIDCITQGRELERPRACPPEVYAIMRGCWQREPQQRHSIKDVHARL QALAQAPPVYLDVLG | 88 |

TABLE P-continued

Fusion Sequences.

| Fusion | SEQUENCE | SEQ ID NO |
|---|---|---|
| MEX3A-<br>NTRK1 | MPSLVVSGIMERNGGFGELGCFGGSAKDRGLLEDERALQLALDQLCLL<br>GLGEPPPAPTAGEDGGGGGGGAPAQPAAPPQPAPPPPPAAPPAAPTAAPA<br>AQTPQPPTAPKGASDAKLCALYKEAELRLKGSSNTTECVPVPTSEHVAE<br>IVGRQVSFSPVDTNSTSGDPVEKKDETPFGVSVAVGLAVFACLFLSTLLL<br>VLNKCGRRNKFGINRPAVLAPEDGLAMSLHFMTLGGSSLSPTEGKGSG<br>LQGHIIENPQYFSDACVHHIKRRDIVLKWELGEGAFGKVFLAECHNLLP<br>EQDKMLVAVKALKEASESARQDFQREAELLTMLQHQHIVRFFGVCTEG<br>RPLLMVFEYMRHGDLNRFLRSHGPDAKLLAGGEDVAPGPLGLGQLLA<br>VASQVAAGMVYLAGLHFVHRDLATRNCLVGQGLVVKIGDFGMSRDIY<br>STDYYRVGGRTMLPIRWMPPESILYRKFTTESDVWSFGVVLWEIFTYGK<br>QPWYQLSNTEAIDCITQGRELERPRACPPEVYAIMRGCWQREPQQRHSI<br>KDVHARLQALAQAPPVYLDVLG | 89 |
| SEL1L-<br>NTRK1 | MRVRIGLTLLLCAVLLSLASASSVPASVQLHTAVEMHHWCIPFSVDGQP<br>APSLRWLFNGSVLNETSFIFTEFLEPAANETVRHGCLRLNQPTHVNNGN<br>YTLLAANPFGQASASIMAAFMDNPFEFNPEDPIPVSFSPVDTNSTSGDPV<br>EKKDETPFGVSVAVGLAVFACLFLSTLLLVLNKCGRRNKFGINRPAVLA<br>PEDGLAMSLHFMTLGGSSLSPTEGKGSGLQGHIIENPQYFSDACVHHIK<br>RRDIVLKWELGEGAFGKVFLAECHNLLPEQDKMLVAVKALKEASESA<br>RQDFQREAELLTMLQHQHIVRFFGVCTEGRPLLMVFEYMRHGDLNRFL<br>RSHGPDAKLLAGGEDVAPGPLGLGQLLAVASQVAAGMVYLAGLHFVH<br>RDLATRNCLVGQGLVVKIGDFGMSRDIYSTDYYRVGGRTMLPIRWMPP<br>ESILYRKFTTESDVWSFGVVLWEIFTYGKQPWYQLSNTEAIDCITQGRE<br>LERPRACPPEVYAIMRGCWQREPQQRHSIKDVHARLQALAQAPPVYLD<br>VLG | 90 |
| NAB2-<br>NTRK1 | MHRAPSPTAEQPPGGGDSARRTLQPRLKPSARAMALPRTLGELQLYRV<br>LQRANLLSYYETFIQQGGDDVQQLCEAGEEEFLEIMALVGMATKPLHV<br>RRLQKALREWATNPGLFSQPVPAVPVSSIPLFKISETAGTRKGSMSNGH<br>GSPGEKAGSARSFSPKSPLELGEKLSPLPGGPGAGDPRIWPGRSTPESDV<br>GAGGEEEAGSPPFSPPAGGGVPEGTGAGGLAAGGTGGGPDRLEPEMVR<br>MVVESVERIFRSFPRGDAGEVTSLLKLNKKLARSVGHIFEMDDNDSQKE<br>EEIRKYSIIYGRFDSKRREGKQLSLHELTINEAAAQFCMRDNTLLLRRVE<br>LFSLSRQVARESTYLSSLKGSRLHPEELGGPPLKKLKQEVGEQSHPEIQQ<br>PPPGPESYVPPYRPSLEEDSASLSGESLDGHLQDTNSTSGDPVEKKDETP<br>FGVSVAVGLAVFACLFLSTLLLVLNKCGRRNKFGINRPAVLAPEDGLA<br>MSLHFMTLGGSSLSPTEGKGSGLQGHIIENPQYFSDACVHHIKRRDIVLK<br>WELGEGAFGKVFLAECHNLLPEQDKMLVAVKALKEASESARQDFQRE<br>AELLTMLQHQHIVRFFGVCTEGRPLLMVFEYMRHGDLNRFLRSHGPDA<br>KLLAGGEDVAPGPLGLGQLLAVASQVAAGMVYLAGLHFVHRDLATRN<br>CLVGQGLVVKIGDFGMSRDIYSTDYYRVGGRTMLPIRWMPPESILYRKF<br>TTESDVWSFGVVLWEIFTYGKQPWYQLSNTEAIDCITQGRELERPRACP<br>PEVYAIMRGCWQREPQQRHSIKDVHARLQALAQAPPVYLDVLG | 91 |
| NTRK1-<br>DUSP10 | MLRGGRRGQLGWHSWAAGPGSLLAWLILASAGAAPCPDACCPHGSSG<br>LRCTRDGALDSLHHLPGAENLTELYIENQQHLQHLELRDLRGLGELRNL<br>TIVKSGLRFVAPDAFHFTPRLSRLNLSFNALESLSWKTVQGLSLQELVLS<br>GNPLHCSCALRWLQRWEEEGLGGVPEQKLQCHGQGPLAHMPNASCGV<br>PTLKVQVPNASVDVGDDVLLRCQVEGRGLEQAGWILTELEQSATVMK<br>SGGLPSLGLTLANVTSDLNRKNVTCWAENDVGRAEVSVQVNVSFPASV<br>QLHTAVEMHHWCIPFSVDGQPAPSLRWLFNGSVLNETSFIFTEFLEPAA<br>NETVRHGCLRLNQPTHVNNGNYTLLAANPFGQASASIMAAFMDNPFEF<br>NPEDPIPVSFSPVDTNSTSGDPVEKKDETPFGVSVAVGLAVFACLFLSTL<br>LLVLNKCGRRNKFGINRGLSSFKQNHENLCDNSLQLQECREVGGGASA<br>ASSLLPQPIPTTPDIENAELTPILPFLFLGNEQDAQDLDTMQRLNIGYVIN<br>VTTHLPLYHYEKGLFNYKRLPATDSNKQNLRQYFEEAFEFIEEAHQCGK<br>GLLIHCQAGVSRSATIVIAYLMKHTRMTMTDAYKFVKGKRPIISPNLNF<br>MGQLLEFEEDLNNGVTPRILTPKLMGVETVV | 92 |
| NTRK1-<br>NLGN1 | MLRGGRRGQLGWHSWAAGPGSLLAWLILASAGAAPCPDACCPHGSSG<br>LRCTRDGALDSLHHLPGAENLTELYIENQQHLQHLELRDLRGLGELRNL<br>TIVKSGLRFVAPDAFHFTPRLSRLNLSFNALESLSWKTVQGLSLQELVLS<br>GNPLHCSCALRWLQRWEEEGLGGVPEQKLQCHGQGPLAHMPNASCGV<br>PTLKVQVPNASVDVGDDVLLRCQVEGRGLEQAGWILTELEQSATVMK<br>SGGLPSLGLTLANVTSDLNRKNVTCWAENDVGRAEVSVQVNVSCFLST<br>GDQAAKGNYGLLDLIQALRWTSENIGFFGGDPLRITVFGSGAGGSCVNL<br>LTLSHYSEGNRWSNSTKGLFQRAIAQSGTALSSWAVSFQPAKYARMLA<br>TKVGCNVSDTVELVECLQKKPYKELVDQDIQPARYHIAFGPVIDGDVIP<br>DDPQILMEQGEFLNYDIMLGVNQGEGLKFVENIVDSDDGISASDFDFAV<br>SNFVDNLYGYPEGKDVLRETIKFMYTDWADRHNPETRRKTLLALFTDH<br>QWVAPAVATADLHSNFGSPTYFYAFYHHCQTDQVPAWADAAHGDEV<br>PYVLGIPMIGPTELFPCNFSKNDVMLSAVVMTYWTNFAKTGDPNQPVP<br>QDTKFIHTKPNRFEEVAWTRYSQKDQLYLHIGLKPRVKEHYRANKVNL<br>WLELVPHLHNLNDISQYTSTTTKVPSTDITFRPTRKNSVPVTSAFPTAKQ | 93 |

TABLE P-continued

Fusion Sequences.

| Fusion | SEQUENCE | SEQ ID NO |
|---|---|---|
| | DDPKQQPSPFSVDQRDYSTELSVTIAVGASLLFLNILAFAALYYKKDKR<br>RHDVHRRCSPQRTTTNDLTHAQEEEIMSLQMKHTDLDHECESIHPHEV<br>VLRTACPPDYTLAMRRSPDDVPLMTPNTITMIPNTIPGIQPLHTFNTFTG<br>GQNNTLPHPHPHPHSHSTTRV | |
| NTRK1-<br>DCST1 | MLRGGRRGQLGWHSWAAGPGSLLAWLILASAGAAPCPDACCPHGSSG<br>LRCTRDGALDSLHHLPGAENLTELYIENQQHLQHLELRDLRGLGELRNL<br>TIVKSGLRFVAPDAFHFTPRLSRLSFSYMDSYNHDIRFDNIYISTYFCQID<br>DRRKKLGKRTLLPLRKAEEKTVIFPCKPTIQASEMSNVVRELLETLPILL<br>LLVVLCGLDWALYSIFDTIRHHSFLQYSFRSSHKLEVKVGGDSMLARLL<br>RKTIGALNTSSETVMESNNMPCLPQPVGLDARAYWRAAVPIGLLVCLC<br>LLQAFGYRLRRVIAAFYFPKREKKRILFLYNDLLKKRAAFTKLRRAAIL<br>RRERQQKAPRHPLADILHRGCPLLRRWLCRRCVVCQAPETPESYVCRT<br>LDCEAVYCWSCWDDMRQRCPVCTPREELSSSAFSDSNDDTAYAG | 94 |
| NOD1-<br>NTRK2 | MEEQGHSEMEIIPSESHPHIQLLKSNRELLVTHIRNTQCLVDNLLK<br>NDYFSAEDAEIVCACPTQPDKVRKILDLVQSKGEEVSEFFLYLLQ<br>QLADAYVDLRPWLLEIGFSPSLLTQSKVVVNTDPVSRYTQQLRH<br>HLGRDSKFVLCYAQKEELLLEEIYMDTIMELVGFSNESLGSLNSL<br>ACLLDHTTGILNEQGETIFILGDAGVGKSMLLQRLQSLWATGRLD<br>AGVKFFFHFRCRMFSCFKESDRLCLQDLLFKHYCYPERDPEEVFA<br>FLLRFPHVALFTFDGLDELHSDLDLSRVPDSSCPWEPAHPLVLLA<br>NLLSGKLLKGASKLLTARTGIEVPRQFLRKKVLLRGFSPSHLRAY<br>ARRMFPERALQDRLLSQLEANPNLCSLCSVPLFCWIIFRCFQHFRA<br>AFEGSPQLPDCTMTLTDVFLLVTEVHLNRMQPSSLVQRNTRSPVE<br>TLHAGRDTLCSLGQVAHRGMEKSLFVFTQEEVQASGLQERDMQ<br>LGFLRALPELGPGGDQQSYEFFHLTLQAFFTAFFLVLDDRVGTQE<br>LLRFFQEWMPPAGAATTSCYPPFLPFQCLQGSGPAREDLFKNKD<br>HFQFTNLFLCGLLSKAKQKLLRHLVPAAALRRKRKALWAHLFSS<br>LRGYLKSLPRVQVESFNQVQAMPTFIWMLRCIYETQSQKVGQLA<br>ARGICANYLKLTYCNACSADCSALSFVLHHFPKRLALDLDNNNL<br>NDYGVRELQPCFSRLTVLRLSVNQITDGGVKVLSEELTKYKIVTY<br>LGLYNNQITDVGARYVTKILDECKGLTHLKLGKNKITSEGGKYL<br>ALAVKNSKSISEVGILVGNPFTCSCDIMWIKTLQEAKSSPDTQDLY<br>CLNESSKNIPLANLQIPNCGLPSANLAAPNLTVEEGKSITLSCSVA<br>GDPVPNMYWDVGNLVSKHMNETSHTQGSLRITNISSDDSGKQIS<br>CVAENLVGEDQDSVNLTVHFAPTITFLESPTSDHHWCIPFTVKGN<br>PKPALQWFYNGAILNESKYICTKIHVTNHTEYHGCLQLDNPTHM<br>NNGDYTLIAKNEYGKDEKQISAHFMGWPGIDDGANPNYPDVIYE<br>DYGTAANDIGDTTNRSNEIPSTDVTDKTGREHLSVYAVVVIASVV<br>GFCLLVMLFLLKLARHSKFGMKDFSWFGFGKVKSRQGVGPASVI<br>SNDDDSASPLHHISNGSNTPSSSEGGPDAVIIGMTKIPVIENPQYFG<br>ITNSQLKPDTFVQHIKRHNIVLKRELGEGAFGKVFLAECYNLCPE<br>QDKILVAVKTLKDASDNARKDFHREAELLTNLQHEHIVKFYGVC<br>VEGDPLEVIVFEYMKHGDLNKFLRAHGPDAVLMAEGNPPTELTQS<br>QMLHIAQQIAAGMVYLASQHFVHRDLATRNCLVGENLLVKIGDF<br>GMSRDVYSTDYYRVGGHTMLPIRWMPPESEVIYRKFTTESDVWS<br>LGVVLWEIFTYGKQPWYQLSNNEVIECITQGRVLQRPRTCPQEVY<br>ELMLGCWQREPHMRKNIKGIHTLLQNLAKASPVYLDILG | 124 |
| PRRX1-<br>NTRK2 | MTSSYGHVLERQPALGGRLDSPGNLDTLQAKKNFSVSHLLDLEEAGDM<br>VAAQADENVGEAGRSLLESPGLTSGSDTPQQDNDQLNSEEKKKRKQRR<br>NRTTFNSSQLQALERVFERTHYPDAFVREDLARRVNLTEARVQVWFQN<br>RRAKFRRNERAMLANKNASLLKSYSGDVTAVEQPIVPRPAPRPTDYLS<br>WGTASPYSNFTRNKLTSLSRKHFRHLDLSELILVGNPFTCSCDIMWIKTL<br>QEAKSSPDTQDLYCLNESSKNIPLANLQIPNCGLPSANLAAPNLTVEEGK<br>SITLSCSVAGDPVPNMYWDVGNLVSKHMNETSHTQGSLRITNISSDDSG<br>KQISCVAENLVGEDQDSVNLTVHFAPTITFLESPTSDHHWCIPFTVKGNP<br>KPALQWFYNGAILNESKYICTKIHVTNHTEYHGCLQLDNPTHMNNGDY<br>TLIAKNEYGKDEKQISAHFMGWPGIDDGANPNYPDVIYEDYGTAANDI<br>GDTTNRSNEIPSTDVTDKTGREHLSVYAVVVIASVVGFCLLVMLFLLKL<br>ARHSKFGMKDFSWFGFGKVKSRQGVGPASVISNDDDSASPLHHISNGS<br>NTPSSSEGGPDAVIIGMTKIPVIENPQYFGITNSQLKPDTFVQHIKRHNIV<br>LKRELGEGAFGKVFLAECYNLCPEQDKILVAVKTLKDASDNARKDFHR<br>EAELLTNLQHEHIVKFYGVCVEGDPLIMVFEYMKHGDLNKFLRAHGPD<br>AVLMAEGNPPTELTQSQMLHIAQQIAAGMVYLASQHFVHRDLATRNC<br>LVGENLLVKIGDFGMSRDVYSTDYYRVGGHTMLPIRWMPPESIMYRKF<br>TTESDVWSLGVVLWEIFTYGKQPWYQLSNNEVIECITQGRVLQRPRTCP<br>QEVYELMLGCWQREPHMRKNIKGIHTLLQNLAKASPVYLDILG | 125 |
| FAM117B-<br>NTRK2 | MSQRVRRNGSPTPAGSLGGGAVATAGGPGSRLQPMRATVPFQLKQQQ<br>QQQHGSPTRSGGGGGGNNNGGCCGGASGPAGGGGGGGPRTASRSTSP<br>TRGGGNAAARTSPTVATQTGASATSTRGTSPTRSAAPGARGSPPRPPPPP<br>PLLGTVSSPSSSPTHLWTGEVSAAPPPARVRHRRRSPEQSRSSPEKRSPS<br>APVCKADFSWFGFGKVKSRQGVGPASVISNDDDSASPLHHISNGSNTPS | 126 |

TABLE P-continued

Fusion Sequences.

| Fusion | SEQUENCE | SEQ ID NO |
|---|---|---|
| | SSEGGPDAVIIGMTKIPVIENPQYFGITNSQLKPDTFVQHIKRHNIVLKRE<br>LGEGAFGKVFLAECYNLCPEQDKILVAVKTLKDASDNARKDFHREAEL<br>LTNLQHEHIVKFYGVCVEGDPLIMVFEYMKHGDLNKFLRAHGPDAVL<br>MAEGNPPTELTQSQMLHIAQQIAAGMVYLASQHFVHRDLATRNCLVG<br>ENLLVKIGDFGMSRDVYSTDYYRVGGHTMLPIRWMPPESIMYRKFTTE<br>SDVWSLGVVLWEIFTYGKQPWYQLSNNEVIECITQGRVLQRPRTCPQE<br>VYELMLGCWQREPHMRKNIKGIHTLLQNLAKASPVYLDILG | |
| PAIP1-<br>NTRK2 | MSDGFDRAPGAGRGRSRGLGRGGGGPEGGGFPNGAGPAERARHQPPQ<br>PKAPGFLQPPPLRQPRTTPPPGAQCEVPASPQRPSRPGALPEQTRPLRAPP<br>SSQDKIPQQNSESAMAKPQVVVAPVLMSKLSVNAPEFYPSGYSSSYTES<br>YEDGCEDYPTLSEYVQDFLNHLTEQPGSFETEIEQFAETLNGCVTTDDA<br>LQELVELIYQQATSIPNFSYMGARLCNYLSHHLTISPQSGNFRQLLLQRC<br>RTEYEVKDQAAKGDEVTRKRFHAFVLFLGELYLNLEIKGTNGQVTRAD<br>ILQVGLRELLNALFSNPMDDNLICAVKLLKLTGSVLEDAWKEKGKMD<br>MEEIIQRIENVVLDANCSRDVKQMLLKLVELRSSNWGRVHATSTYREA<br>TPENDPNYFMNEPTFYTSDGVPFTAADPDYGTAANDIGDTTNRSNEIPS<br>TDVTDKTGREHLSVYAVVVIASVVGFCLLVMLFLLKLARHSKFGMKDF<br>SWFGFGKVKSRQGVGPASVISNDDDSASPLHHISNGSNTPSSSEGGPDA<br>VIIGMTKIPVIENPQYFGITNSQLKPDTFVQHIKRHNIVLKRELGEGAFGK<br>VFLAECYNLCPEQDKILVAVKTLKDASDNARKDFHREAELLTNLQHEH<br>IVKFYGVCVEGDPLIMVFEYMKHGDLNKFLRAHGPDAVLMAEGNPPTE<br>LTQSQMLHIAQQIAAGMVYLASQHFVHRDLATRNCLVGENLLVKIGDF<br>GMSRDVYSTDYYRVGGHTMLPIRWMPPESIMYRKFTTESDVWSLGVV<br>LWEIFTYGKQPWYQLSNNEVIECITQGRVLQRPRTCPQEVYELMLGCW<br>QREPHMRKNIKGIHTLLQNLAKASPVYLDILG | 127 |
| CTDSP2-<br>NTRK2 | MEHGSIITQARREDALVLTKQGPASVISNDDDSASPLHHISNGSNTPSSS<br>EGGPDAVIIGMTKIPVIENPQYFGITNSQLKPDTFVQHIKRHNIVLKRELG<br>EGAFGKVFLAECYNLCPEQDKILVAVKTLKDASDNARKDFHREAELLT<br>NLQHEHIVKFYGVCVEGDPLIMVFEYMKHGDLNKFLRAHGPDAVLMA<br>EGNPPTELTQSQMLHIAQQIAAGMVYLASQHFVHRDLATRNCLVGENL<br>LVKIGDFGMSRDVYSTDYYRVGGHTMLPIRWMPPESIMYRKFTTESDV<br>WSLGVVLWEIFTYGKQPWYQLSNNEVIECITQGRVLQRPRTCPQEVYE<br>LMLGCWQREPHMRKNIKGIHTLLQNLAKASPVYLDILG | 128 |
| PCSKS-<br>NTRK2 | MGWGSRCCCPGRLDLLCVLALLGGCLLPVCRTRVYTNHWAVKIAGGF<br>PEANRIASKYGFINIGQIGALKDYYHFYHSRTIKRSVISSRGTHSFISMEP<br>KVEWIQQQVVKKRTKRDYDFSRAQSTYFNDPKWPSMWYMHCSDNTH<br>PCQSDMNIEGAWKRGYTGKNIVVTILDDGIERTHPDLMQNYDALASCD<br>VNGNDLDPMPRYDASNENKHGTRCAGEVAAAANNSHCTVGIAFNAKI<br>GGVRMLDGDVTDMVEAKSVSFNPQHVHIYSASWGPDDDGKTVDGPAP<br>LTRQAFENGVRMGRRGLGSVFVWASGNGGRSKDHCSCDGYTNSIYTIS<br>ISSTAESGKKPWYLEECSSTLATTYSSGESYDKKIITTDLRQRCTDNHTG<br>TSASAPMAAGIIALALEANPFLTWRDVQHVIVRTSRAGHLNANDWKTN<br>AAGFKVSHLYGFGLMDAEAMVMEAEKWTTVPRQHVCVESTDRQIKTI<br>RPNSAVRSIYKASGCSDNPNRHVNYLEHVVVRITITHPRRGDLAIYLTSP<br>SGTRSQLLANRLFDHSMEGFKNWEFMTIHCWGERAAGDWVLEVYDTP<br>SQLRNFKTPGKLKEWSLVLYGTSVQPYSPTNEFPKVERFRYSRVEDPTD<br>DYGTEDYAGPCDPECSEVGCDGPGPDHCNDCLHYYYKLKNNTRICVSS<br>CPPGHYHADKKRCRKCAPNCESCFGSHGDQCMSCKYGYFLNEETNSC<br>VTHCPDGSYQDTKKNLCRKCSENCKTCTEFHNCTECRDGLSLQGSRCS<br>VSCEDGRYFNGQDCQPCHRFCATCAGAGADGCINCTEGYFMEDGRCV<br>QSCSISYYFDHSSENGYKSCKKCDISCLTCNGPGFKNCTSCPSGYLLDLG<br>MCQMGAICKDGEYVDEHGHCQTCEASCAKCQGPTQEDCTTCPMTRIF<br>DDGRCVSNCPSWKFEFENQCHPCHHTCQRCQGSGPTHCTSCGADNYG<br>REHFLYQGECGDSCPEGHYATEGNTCLPCPDNCELCHSVHVCTRCMKG<br>YFIAPTNHTCQKLECGQGEVQDPDYEECVPCEEGCLGCSLDYGTAANDI<br>GDTTNRSNEIPSTDVTDKTGREHLSVYAVVVIASVVGFCLLVMLFLLKL<br>ARHSKFGMKDFSWFGFGKVKSRQGVGPASVISNDDDSASPLHHISNGS<br>NTPSSSEGGPDAVIIGMTKIPVIENPQYFGITNSQLKPDTFVQHIKRHNIV<br>LKRELGEGAFGKVFLAECYNLCPEQDKILVAVKTLKDASDNARKDFHR<br>EAELLTNLQHEHIVKFYGVCVEGDPLIMVFEYMKHGDLNKFLRAHGPD<br>AVLMAEGNPPTELTQSQMLHIAQQIAAGMVYLASQHFVHRDLATRNC<br>LVGENLLVKIGDFGMSRDVYSTDYYRVGGHTMLPIRWMPPESIMYRKF<br>TTESDVWSLGVVLWEIFTYGKQPWYQLSNNEVIECITQGRVLQRPRTCP<br>QEVYELMLGCWQREPHMRKNIKGIHTLLQNLAKASPVYLDILG | 129 |
| BLM-<br>NTRK3 | MAAVPQNNLQEQLERHSARTLNNKLSLSKPKFSGFTFKKKTSSD<br>NNVSVTNVSVAKTPVLRNKDVNVTEDFSFSEPLPNTTNQQRVKD<br>FFKNAPAGQETQRGGSKSLLPDFLQTPKEVVCTTQNTPTVKKSRD<br>TALKKLEFSSSPDSLSTINDWDDMDDFDTSETSKSFVTPPQSHFVR<br>VSTAQKSKKGKRNFFKAQLYTTNTVKTDLPPPSSESEQIDLTEEQ<br>KDDSEWLSSDVICIDDGPIAEVHINEDAQESDSLKTHLEDERGPV<br>AVISGEEDSASPLHHINHGITTPSSLDAGPDTVVIGMTRIPVIENPQ | 177 |

TABLE P-continued

| Fusion Sequences. | | |
|---|---|---|
| Fusion | SEQUENCE | SEQ ID NO |
| | YFRQGHNCHKPDTYVQHIKRRDIVLKRELGEGAFGKVFLAECYN LSPTKDKMLVAVKALKDPTLAARKDFQREAELLTNLQHEHIVKF YGVCGDGDPLEVIVFEYMKHGDLNKFLRAHGPDAMILVDGQPRQ AKGELGLSQMLHIASQIASGMVYLASQHFVHRDLATRNCLVGAN LLVKIGDFGMSRDVYSTDYYRVGGHTMLPIRWMPPESIMYRKFT TESDVWSFGVILWEIFTYGKQPWFQLSNTEVIECITQGRVLERPRV CPKEVYDVMLGCWQREPQQRLNIKEIYKILHALGKATPIYLDILG | |
| NTRK3-EFTUD1 | MDVSLCPAKCSFWRIFLLGSVWLDYVGSVLACPANCVCSKTEIN CRRPDDGNLFPLLEGQDSGNSNGNASINTTDISRNITSIHIENWRSL HTLNAVDMELYTGLQKLTIKNSGLRSIQPRAFAKNPHLRYINLSS NRLTTLSWQLFQTLSLRELQLEQNFFNCSCDIRWMQLWQEQGEA KLNSQNLYCINADGSQLPLFRMNISQCDLPEISVSHVNLTVREGD NAVITCNGSGSPLPDVDWIVTGLQSINTHQTNLNWTNVHAINLTL VNVTSEDNGFTLTCIAENVVGMSNASVALTVYYPPRVVSLEEPEL RLEHCIEFVVRGNPPPTLHWLHNGQPLRESKIIHVEYYQEGEISEG CLLFNKPTHYNNGNYTLIAKNPLGTANQTINGHFLKEPFPESTDN FILCEMPQLVKGMKLLNQADPCVQILIQETGEHVLVTAGEVHLQ RCLDDLKERFAKIHISVSEPIIPFRETITKPPKVDMVNEEIGKQQKV AVIHQMKEDQSKIPEGIQVDSDGLITITTPNKLATLSVRAMPLPEE VTQILEENSDLIRSMEQLTSSLNEGENTHMIHQKTQEKIWEFKGK LEQHLTGRRWRNIVDQIWSFGPRKCGPNILVNKSEDFQNSVWTG PADKASKEASRYRDLGNSIVSGFQLATLSGPMCEEPLMGVCFVLE KWDLSKFEEQGASDLAKEGQEENETCSGGNENQELQDGCSEAFE KRTSQKGESPLTDCYGPFSGQLIATMKEACRYALQVKPQRLMAA MYTCDIMATGDVLGRVYAVLSKREGRVLQEEMKEGTDMFIIKA VLPVAESFGFADEIRKRTSGLASPQLVFSHWEIIPSDPFWVPTTEEE YLHFGEKADSENQARKYMNAVRKRKGLYVEEKIVEHAEKQRTL SKNK | 178 |
| NTRK3-LRRK1 | MDVSLCPAKCSFWRIFLLGSVWLDYVGSVLACPANCVCSKTEIN CRRPDDGNLFPLLEGQDSGNSNGNASINITDISRNITSIHIENWRSL HTLNAVDMELYTGLQKLTIKNSGLRSIQPRAFAKNPHLRYIYLLP HLLPSKPGLDTHGMRHPTANTIQRVFKMSFVPVGFWQRFIARMLI SLAEMDLQLFENKKNTKSRNRKVTIYSFTGNQRNRCSTFRVKRN QTIYWQEGLLVTFDGGYLSVESSDVNWKKKKSGGMKIVCQSEV RDFSAMAFITDHVNSLIDQWFPALTATESDGTPLMEQYVPCPVCE TAWAQHTDPSEKSEDVQYFDMEDCVLTAIERDFISCPRHPDLPVP LQELVPELFMTDFPARLFLENSKLEHSEDEGSVLGQGGSGTVIYR ARYQGQPVAVKRFHIKKFKNFANVPADTMLRHLRATDAMKNFS EFRQEASMLHALQHPCIVALIGISIHPLCFALELAPLSSLNTVLSEN ARDSSFIPLGHMLTQKIAYQIASGLAYLHKKNIIFCDLKSDNILVW SLDVKEHINIKLSDYGISRQSFHEGALGVEGTPGYQAPEIRPRIVY DEKVDMFSYGMVLYELLSGQRPALGHHQLQIAKKLSKGIRPVLG QPEEVQFRRLQALMMECWDTKPEKRPLALSVVSQMKDPTFATF MYELCCGKQTAFFSSQGQEYTVVFWDGKEESRNYTVVNTEKGL MEVQRMCCPGMKVSCQLQVQRSLWTATEDQKIYIYTLKGMCPL NTPQQALDTPAVVTCFLAVPVIKKNSYLVLAGLADGLVAVFPVV RGTPKDSCSYLCSHTANRSKFSIADEDARQNPYPVKAMEVVNSG SEVWYSNGPGLLVIDCASLEICRRLEPYMAPSMVTSVVCSSEGRG EEVVWCLDDKANSLVMYHSTTYQLCARYFCGVPSPLRDMFPVR PLDTEPPAASHTANPKVPEGDSIADVSEVIYSEELGTQILIHQESLTD YCSMSSYSSSPPRQAARSPSSLPSSPASSSSVPFSTDCEDSDMLHTP GAASDRSEHDLTPMDGETFSQHLQAVKILAVRDLIWVPRRGGDV IVIGLEKDSGAQRGRVIAVLKARELTPHGVLVDAAVVAKDTVVC TFENENTEWCLAVWRGWGAREFDIFYQSYEELGRLEACTRKRR | 179 |
| HMBOX1-NTRK3 | MLSSFPVVLLETMSHYTDEPRFTIEQIDLLQRLRRTGMTKHEILHALETL DRLDQEHSDKFGRRSSYGGSSYGNSTNNVPASSSTATASTQTQHSGMSP SPSNSYDTSPQPCTTNQNGRENNERLSTSNGKMSPTRYHANSMGQRSY SFEASEEDLDVDDKVEELMRRDSSVIKEEIKAFLANRRISQAVVAQVTG PVAVISGEEDSASPLHHINHGITTPSSLDAGPDTVVIGMTRIPVIENPQYF RQGHNCHKPDTYVQHIKRRDIVLKRELGEGAFGKVFLAECYNLSPTKD KMLVAVKALKDPTLAARKDFQREAELLTNLQHEHIVKFYGVCGDGDP LIMVFEYMKHGDLNKFLRAHGPDAMILVDGQPRQAKGELGLSQMLHI ASQIASGMVYLASQHFVHRDLATRNCLVGANLLVKIGDFGMSRDVYST DYYRVGGHTMLPIRWMPPESIMYRKFTTESDVWSFGVILWEIFTYGKQ PWFQLSNTEVIECITQGRVLERPRVCPKEVYDVMLGCWQREPQQRLNI KEIYKILHALGKATPIYLDILG | 180 |
| RUNX1-NTRK3 | MASDSIFESFPSYPQCFMRECILGMNPSRDVHDASTSRRFTPPSTALSPG KMSEALPLGAPDAGAALAGKLRSGDRSMVEVLADHPGELVRTDSPNFL CSVLPTHWRCNKTLPIAFKVVALGDVPDGTLVTVMAGNDENYSAELR NATAAMKNQVARFNDLRFVGRSGRDLPEISVSHVNLTVREGDNAVITC NGSGSPLPDVDWIVTGLQSINTHQTNLNWTNVHAINLTLVNVTSEDNG | 181 |

TABLE P-continued

| Fusion Sequences. | | |
|---|---|---|
| Fusion | SEQUENCE | SEQ ID NO |
| | FTLTCIAENVVGMSNASVALTVYYPPRVVSLEEPELRLEHCIEFVVRGN PPPTLHWLHNGQPLRESKIIHVEYYQEGEISEGCLLFNKPTHYNNGNYT LIAKNPLGTANQTINGHFLKEPFPESTDNFILFDEVSPTPPITVTHKPEEDT FGVSIAVGLAAFACVLLVVLFVMINKYGRRSKFGMKGPVAVISGEEDS ASPLHHINHGITTPSSLDAGPDTVVIGMTRIPVIENPQYFRQGHNCHKPD TYVQHIKRRDIVLKRELGEGAFGKVFLAECYNLSPTKDKMLVAVKALK DPTLAARKDFQREAELLTNLQHEHIVKFYGVCGDGDPLIMVFEYMKHG DLNKFLRAHGPDAMILVDGQPRQAKGELGLSQMLHIASQIASGMVYLA SQHFVHRDLATRNCLVGANLLVKIGDFGMSRDVYSTDYYRVGGHTML PIRWMPPESIMYRKFTTESDVWSFGVILWEIFTYGKQPWFQLSNTEVIEC ITQGRVLERPRVCPKEVYDVMLGCWQREPQQRLNIKEIYKILHALGKAT PIYLDILG | |
| DLG1-NTRK3 | MPVRKQDTQRALHLLEEYRSKLSQTEDRQLRSSIERVINIFQSNLFQALI DIQEFYEVTLLDNPKCIDRSKPSEPIQPVNTWEISSLPSSTVTSETLPSSLS PSVEKYRYQDEDTPPQEHISPQITNEVIGPELVHVSEKNLSEIENVHGFVS HSHISPIKPTEAVLPSPPTVPVIPVLPVPAENTVILPTIPQANPPPVLVNTDS LETPTYVNGTDADYEYEEITLERGNSGLGFSIAGGTDNPHIGDDSSIFITK IITGGAAAQDGRLRVNDCILRVNEVDVRDVTHSKAVEALKEAGSIVRL YVKRRKPVSEKIMEIKLIKGPKESTDNFILFDEVSPTPPITVTHKPEEDTF GVSIAVGLAAFACVLLVVLFVMINKYGRRSKFGMKGPVAVISGEEDSA SPLHHINHGITTPSSLDAGPDTVVIGMTRIPVIENPQYFRQGHNCHKPDT YVQHIKRRDIVLKRELGEGAFGKVFLAECYNLSPTKDKMLVAVKALKD PTLAARKDFQREAELLTNLQHEHIVKFYGVCGDGDPLIMVFEYMKHGD LNKFLRAHGPDAMILVDGQPRQAKGELGLSQMLHIASQIASGMVYLAS QHFVHRDLATRNCLVGANLLVKIGDFGMSRDVYSTDYYRVGGHTMLP IRWMPPESIMYRKFTTESDVWSFGVILWEIFTYGKQPWFQLSNTEVIECI TQGRVLERPRVCPKEVYDVMLGCWQREPQQRLNIKEIYKILHALGKAT PIYLDILG | 182 |
| AMMECR1-NTRK3 | MAAGCCGVKKQKLSSSPPSGSGGGGGASSSSHCSGESQCRAGELGLGG AGTRLNGLGGLTGGGSGSGCTLSPPQGCGGGGGGIALSPPPSCGVGTLL STPAAATSSSPSSSSAASSSSPGSRKMVVSAEMCCFCFDVLYCHLYGYQ QPRTPRFTNEPYPLFVTWKIGRDKRLRGCIGTFSAMNLHSGLREYTLTR NLSSNRLTTLSWQLFQTLSLRELQLEQNFFNCSCDIRWMQLWQEQGEA KLNSQNLYCINADGSQLPLFRMNISQCDLPEISVSHVNLTVREGDNAVIT CNGSGSPLPDVDWIVTGLQSINTHQTNLNWTNVHAINLTLVNVTSEDN GFTLTCIAENVVGMSNASVALTVYYPPRVVSLEEPELRLEHCIEFVVRG NPPPTLHWLHNGQPLRESKIIHVEYYQEGEISEGCLLFNKPTHYNNGNY TLIAKNPLGTANQTINGHFLKEPFPESTDNFILFDEVSPTPPITVTHKPEED TFGVSIAVGLAAFACVLLVVLFVMINKYGRRSKFGMKGPVAVISGEEDS ASPLHHINHGITTPSSLDAGPDTVVIGMTRIPVIENPQYFRQGHNCHKPD TYVQHIKRRDIVLKRELGEGAFGKVFLAECYNLSPTKDKMLVAVKALK DPTLAARKDFQREAELLTNLQHEHIVKFYGVCGDGDPLIMVFEYMKHG DLNKFLRAHGPDAMILVDGQPRQAKGELGLSQMLHIASQIASGMVYLA SQHFVHRDLATRNCLVGANLLVKIGDFGMSRDVYSTDYYRVGGHTML PIRWMPPESIMYRKFTTESDVWSFGVILWEIFTYGKQPWFQLSNTEVIEC ITQGRVLERPRVCPKEVYDVMLGCWQREPQQRLNIKEIYKILHALGKAT PIYLDILG | 183 |
| TNRC6A-NTRK3 | MRELEAKATKDVERNLSRDLVQEEEQLMEEKKKKKDDKKKKEAAQK KATEQKIKDVQHIKRRDIVLKRELGEGAFGKVFLAECYNLSPTKDKML VAVKALKDPTLAARKDFQREAELLTNLQHEHIVKFYGVCGDGDPLIMV FEYMKHGDLNKFLRAHGPDAMILVDGQPRQAKGELGLSQMLHIASQIA SGMVYLASQHFVHRDLATRNCLVGANLLVKIGDFGMSRDVYSTDYYR VGGHTMLPIRWMPPESIMYRKFTTESDVWSFGVILWEIFTYGKQPWFQ LSNTEVIECITQGRVLERPRVCPKEVYDVMLGCWQREPQQRLNIKEIYKI LHALGKATPIYLDILG | 184 |
| IQGAP1-NTRK3 | MSAADEVDGLGVARPHYGSVLDNERLTAEEMDERRRQNVAYEYLCHL EEAKRWMEACLGEDLPPTTELEEGLRNGVYLAKLGNFFSPKVVSLKKI YDREQTRYKATGLHFRHTDNVIQWLNAMDEIGLPKIFYPETTDIYDRKN MPRCIYCIHALSLYLFKLGLAPQIQDLYGKVDFTEEEINNMKTELEKYGI QMPAFSKIGGILANELSVDEAALHAAVIAINEAIDRRIPADTFAALKNPN AMLVNLEEPLASTYQDILYQAKQDKMTNAKNRTENSERERDVYEELLT QAEIQGNINKVNKSTDNFILFDEVSPTPPITVTHKPEEDTFGVSIAVGLAA FACVLLVVLFVMINKYGRRSKFGMKGPVAVISGEEDSASPLHHINHGIT TPSSLDAGPDTVVIGMTRIPVIENPQYFRQGHNCHKPDTYVQHIKRRDIV LKRELGEGAFGKVFLAECYNLSPTKDKMLVAVKALKDPTLAARKDFQ REAELLTNLQHEHIVKFYGVCGDGDPLIMVFEYMKHGDLNKFLRAHGP DAMILVDGQPRQAKGELGLSQMLHIASQIASGMVYLASQHFVHRDLAT RNCLVGANLLVKIGDFGMSRDVYSTDYYRVGGHTMLPIRWMPPESIM YRKFTTESDVWSFGVILWEIFTYGKQPWFQLSNTEVIECITQGRVLERPR VCPKEVYDVMLGCWQREPQQRLNIKEIYKILHALGKATPIYLDILG | 185 |

TABLE P-continued

| Fusion Sequences. | | |
|---|---|---|
| Fusion | SEQUENCE | SEQ ID NO |
| CARM1-NTRK3 | MAAAAAAVGPGAGGAGSAVPGGAGPCATVSVFPGARLLTIGDANGEI<br>QRHAEQQALRLEVRAGPDSAGIALYSHEDVCVFKCSVSRETECSRVGK<br>QSFIITLGCNSVLIQFATPNDFCSFYNILKTCRGHTLERSVFSERTEESSAV<br>QYFQKQRSEMDVSLCPAKCSFWRIFLLGSVWLDYVGSVLACPANCVCS<br>KTEINCRRPDDGNLFPLLEGQDSGNSNGNASINITDISRNITSIHIENWRS<br>LHTLNAVDMELYTGLQKLTIKNSGLRSIQPRAFAKNPHLRYINLSSNRL<br>TTLSWQLFQTLSLRELQLEQNFFNCSCDIRWMQLWQEQGEAKLNSQNL<br>YCINADGSQLPLFRMNISQCDLPEISVSHVNLTVREGDNAVITCNGSGSP<br>LPDVDWIVTGLQSINTHQTNLNWTNVHAINLTLVNVTSEDNGFTLTCIA<br>ENVVGMSNASVALTVYYPPRVVSLEEPELRLEHCIEFVVRGNPPPTLHW<br>LHNGQPLRESKIIHVEYYQEGEISEGCLLFNKPTHYNNGNYTLIAKNPLG<br>TANQTINGHFLKEPFPESTDNFILFDEVSPTPPITVTHKPEEDTFGVSIAVG<br>LAAFACVLLVVLFVMINKYGRRSKFGMKGPVAVISGEEDSASPLHHINH<br>GITTPSSLDAGPDTVVIGMTRIPVIENPQYFRQGHNCHKPDTYVQHIKRR<br>DIVLKRELGEGAFGKVFLAECYNLSPTKDKMLVAVKALKDPTLAARKD<br>FQREAELLTNLQHEHIVKFYGVCGDGDPLIMVFEYMKHGDLNKFLRAH<br>GPDAMILVDGQPRQAKGELGLSQMLHIASQIASGMVYLASQHFVHRDL<br>ATRNCLVGANLLVKIGDFGMSRDVYSTDYYRVGGHTMLPIRWMPPESI<br>MYRKFTTESDVWSFGVILWEIFTYGKQPWFQLSNTEVIECITQGRVLER<br>PRVCPKEVYDVMLGCWQREPQQRLNIKEIYKILHALGKATPIYLDILG | 12 |

The specification is considered to be sufficient to enable one skilled in the art to practice the invention. Various modifications of the invention in addition to those shown and described herein will become apparent to those skilled in the art from the foregoing description and fall within the scope of the appended claims. All publications, patents, and patent applications cited herein are hereby incorporated by reference in their entirety for all purposes.

ENUMERATED EMBODIMENTS

The following enumerated embodiments are representative of some aspects of the invention.

1. An isolated MEX3A-NTRK1 fusion nucleic acid molecule comprising a nucleotide sequence chosen from:
   - (i) a nucleotide sequence comprising exon 1 of SEQ ID NO: 1 (MEX3A) and one or more, or all, of exons 9-17 of SEQ ID NO: 3 (NTRK1), or a nucleotide sequence at least 70%, 75%, 80%, 85%, 90%, 91%, 92%, 93%, 94% 95%, 96%, 97%, 98%, 99%, or 99.5% identical thereto;
   - (ii) a nucleotide sequence comprising the nucleotide sequence of SEQ ID NO: 5, or a nucleotide sequence at least 70%, 75%, 80%, 85%, 90%, 91%, 92%, 93%, 94% 95%, 96%, 97%, 98%, 99%, or 99.5% identical thereto;
   - (iii) a nucleotide sequence encoding the amino acid sequence of SEQ ID NO: 6, or a nucleotide sequence at least 70%, 75%, 80%, 85%, 90%, 91%, 92%, 93%, 94% 95%, 96%, 97%, 98%, 99%, or 99.5% identical thereto;
   - (iv) a nucleotide sequence comprising all or a portion of the MEX3A-NTRK1 fusion nucleic acid molecule Breakpoint 1 and/or Breakpoint 2 depicted in FIG. 1A; or
   - (v) a fragment of any of (i)-(iv) comprising a nucleotide sequence from a MEX3A gene and a nucleotide sequence from an NTRK1 gene.
2. A nucleic acid molecule that is capable of hybridizing to the nucleic acid molecule of embodiment 1.
3. A fragment of the nucleic acid molecule of embodiment 1 or 2, wherein said fragment comprises between 10 and 25 nucleotides, or between 100 and 300 nucleotides.
4. The fragment of embodiment 3, which is a probe or primer that comprises about 5 and 25 nucleotides.
5. The fragment of embodiment 3, which is a bait that comprises between about 100 and 300 nucleotides, 130 and 230 nucleotides, or 150 and 200 nucleotides.
6. A nucleic acid molecule suitable as a probe, primer, bait, or library member, that specifically binds to the nucleic acid molecule of embodiment 1 or 2, or the fragment of any of embodiments 3-5.
7. The nucleic acid molecule of embodiment 1 or 2, or the fragment of any of embodiments 3-5, which is operatively linked to a native or a heterologous regulatory nucleotide sequence.
8. A vector comprising a nucleic acid molecule of embodiment 1 or 2, or a fragment of any of embodiments 3-5.
9. A host cell comprising a vector of embodiment 8.
10. A nucleic acid molecule that specifically reduces or inhibits the expression, or alters a function, of the nucleic acid molecule of embodiment 1 or 2.
11. The nucleic acid molecule of embodiment 10, which is chosen from an antisense molecule, a ribozyme, an siRNA, a guide RNA (gRNA), or a triple helix molecule.
12. An isolated MEX3A-NTRK1 fusion polypeptide comprising an amino acid sequence chosen from:
    - (i) the amino acid sequence encoded by exon 1 of SEQ ID NO: 1 (MEX3A) and encoded by one or more, or all, of exons 9-17 of SEQ ID NO: 3 (NTRK1), or an amino acid sequence at least 70%, 75%, 80%, 85%, 90%, 91%, 92%, 93%, 94% 95%, 96%, 97%, 98%, 99%, or 99.5% identical thereto;
    - (ii) the amino acid sequence encoded by the nucleotide sequence of SEQ ID NO: 5, or an amino acid sequence at least 70%, 75%, 80%, 85%, 90%, 91%, 92%, 93%, 94% 95%, 96%, 97%, 98%, 99%, or 99.5% identical thereto;
    - (iii) the amino acid sequence of SEQ ID NO: 6, or an amino acid sequence at least 70%, 75%, 80%, 85%, 90%, 91%, 92%, 93%, 94% 95%, 96%, 97%, 98%, 99%, or 99.5% identical thereto;
    - (iv) the amino acid sequence encoded by a nucleotide sequence comprising all or a portion of a MEX3A-

NTRK1 fusion nucleic acid molecule Breakpoint 1 and/or Breakpoint 2 depicted in FIG. 1A; or (v) a fragment of any of (i)-(iv) comprising an amino acid sequence from a MEX3A polypeptide and an amino acid sequence from an NTRK1 polypeptide.

13. The polypeptide of embodiment 12, having a TRKA kinase activity, and/or a dimerizing or multimerizing activity.

14. An isolated antibody molecule that specifically binds to the polypeptide of embodiment 12 or 13.

15. A reaction mixture comprising:

a detection reagent capable of detecting a rearrangement associated with a MEX3A gene and/or an NTRK1 gene; and a target nucleic acid derived from a cancer, wherein the target nucleic acid comprises the nucleic acid molecule of any of embodiments 1-3.

16. The reaction mixture of embodiment 15, wherein the detection reagent detects the nucleotide sequence of a MEX3A-NTRK1 fusion nucleic acid molecule.

17. The reaction mixture of embodiment 15 or 16, wherein the detection reagent distinguishes the nucleotide sequence of a MEX3A-NTRK1 fusion nucleic acid molecule, from a wildtype MEX3A or NTRK1 nucleotide sequence, or the nucleotide sequence of a second MEX3A or NTRK1 fusion nucleic acid molecule.

18. The reaction mixture of any of embodiments 15-17, wherein the detection reagent comprises a DNA, RNA, or mixed DNA/RNA molecule comprising a nucleotide sequence that is complementary to a MEX3A-NTRK1 fusion nucleic acid molecule.

19. The reaction mixture of any of embodiments 15-18, wherein the detection reagent detects the fusion junction of a MEX3A-NTRK1 fusion nucleic acid molecule.

20. A method of making a reaction mixture comprising:

combining a detection reagent capable of detecting a rearrangement associated with a MEX3A gene and/or an NTRK1 gene with a target nucleic acid derived from a cancer, wherein the target nucleic acid comprises the nucleic acid molecule of embodiment 1 or 2.

21. A preparation of the nucleic acid molecule of embodiment 1 or 2, or the fragment of any of embodiments 3-5, disposed in a sequencing device, or a sample holder for use in such a device.

22. A preparation of the nucleic acid molecule of embodiment 1 or 2, or the fragment of any of embodiments 3-5, disposed in a device for determining a physical or chemical property, or a sample holder for use in such a device.

23. A detection reagent comprising a DNA, RNA, or mixed DNA/RNA molecule, comprising a nucleotide sequence that is complementary to the nucleotide sequence of a MEX3A-NTRK1 fusion nucleic acid molecule.

24. A kit comprising the detection reagent of embodiment 23 and instructions for use of the detection reagent to detect a MEX3A-NTRK1 fusion nucleic acid molecule.

25. A reaction mixture, comprising:

a detection reagent capable of detecting a structural or functional property of a MEX3A-NTRK1 fusion polypeptide; and a target protein derived from a cancer, wherein the target protein comprises the polypeptide of embodiment 12 or 13.

26. A method of making a reaction mixture, comprising:

combining a detection reagent capable of detecting a structural or functional property of a MEX3A-NTRK1 fusion polypeptide; with a target protein derived from a cancer, wherein the target protein comprises the polypeptide of embodiment 12 or 13.

27. A kit comprising the antibody molecule of embodiment 14 and instructions for use of the antibody molecule to detect a MEX3A-NTRK1 fusion polypeptide.

28. A method of reducing an activity or expression of the MEX3A-NTRK1 fusion polypeptide of embodiment 12 or 13, comprising:

optionally, acquiring knowledge of the presence of the MEX3A-NTRK1 fusion polypeptide; and contacting the MEX3A-NTRK1 fusion polypeptide, or a cell expressing the MEX3A-NTRK1 fusion polypeptide, with an agent that reduces an activity or expression of the MEX3A-NTRK1 fusion polypeptide.

29. The method of embodiment 28, wherein the contacting step is effected in vitro.

30. The method of embodiment 28, wherein the contacting step is effected in vivo.

31. The method of embodiment 30, wherein the contacting step is effected in a human or animal subject.

32. An anti-cancer agent for use in treating a cancer in a subject, wherein the use comprises acquiring knowledge of the presence of the MEX3A-NTRK1 fusion nucleic acid molecule of any of embodiments 1-3 or a MEX3A-NTRK1 fusion polypeptide of embodiment 12 or 13 in the subject.

33. The anti-cancer agent for use of embodiment 32, wherein said anti-cancer agent comprises a kinase inhibitor.

34. The anti-cancer agent for use of embodiment 33, wherein the kinase inhibitor is administered responsive to a determination of presence of the MEX3A-NTRK1 fusion nucleic acid molecule or MEX3A-NTRK1 fusion polypeptide in a sample from said subject.

35. The anti-cancer agent for use of embodiment 32, wherein said use is responsive to acquiring knowledge or information of the presence of the MEX3A-NTRK1 fusion nucleic acid molecule or MEX3A-NTRK1 fusion polypeptide in said subject.

36. The anti-cancer agent for use of embodiment 32, wherein said use is responsive to acquiring knowledge or information of the presence of the MEX3A-NTRK1 fusion nucleic acid molecule or MEX3A-NTRK1 fusion polypeptide in said subject from another party.

37. The anti-cancer agent for use of embodiment 32, wherein the use comprises receiving a communication of the presence of the MEX3A-NTRK1 fusion nucleic acid molecule or MEX3A-NTRK1 fusion polypeptide in the subject.

38. The anti-cancer agent for use of embodiment 32, wherein said use is responsive to an identification of the presence of the MEX3A-NTRK1 fusion nucleic acid molecule or MEX3A-NTRK1 fusion polypeptide in the subject, wherein said identification arises from collaboration with another party.

39. The anti-cancer agent for use of embodiment 32, comprising determining the presence of the MEX3A-NTRK1 fusion nucleic acid molecule or MEX3A-NTRK1 fusion polypeptide by sequencing.

40. The anti-cancer agent for use of any of embodiments 32-39, wherein said cancer is chosen from an ovarian cancer, a salivary gland mammary analogue secretory carcinoma, a soft tissue fibrosarcoma, a salivary gland tumor, histiocytosis, a thyroid tumor, a soft tissue sarcoma, or a chondrosarcoma.

41. The anti-cancer agent for use of embodiment 40, wherein the cancer is ovarian cancer.

42. The anti-cancer agent for use of embodiment 41, wherein the ovarian cancer is an ovarian carcinosarcoma.

43. The anti-cancer agent for use of any of embodiments 32-42, wherein the cancer has no detectable altered level or activity in one or more of EGFR, KRAS, ALK, ROS1 or RET.

44. The anti-cancer agent for use of any of embodiments 32-43, wherein the anti-cancer agent comprises a kinase inhibitor that selectively inhibits a kinase activity of the MEX3A-NTRK1 fusion polypeptide.

45. The anti-cancer agent for use of any of embodiments 32-44, wherein the anti-cancer agent comprises a kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolo-carboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1, 5a]pyrimidine, a pyridocarbazole, a pyridoquinazolinyl, a pyridotriazole, a pyrrolidinyl thiourea, a pyrrolidinyl urea, a pyrrolo [2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928.

46. The anti-cancer agent for use of embodiment 45, wherein the kinase inhibitor is ARRY-470 or larotrectinib, AZ-23, danusertib (PHA-739358), entrectinib, lestaurtinib (CEP-701), AZD7451, belizatinib, selitrectinib, or crizotinib.

47. The anti-cancer agent for use of any of embodiments 32-46, wherein the anti-cancer agent comprises a kinase inhibitor chosen from an antisense molecule, a ribozyme, an siRNA, a triple helix-forming oligonucleotide, or a gRNA, each of which hybridizes to a MEX3A-NTRK1 fusion nucleic acid molecule, or a transcription regulatory region thereof.

48. The anti-cancer agent for use of any of embodiments 32-47, wherein the anti-cancer agent is used in combination with a second therapeutic agent or modality.

49. The anti-cancer agent for use of embodiment 48, wherein the second therapeutic agent comprises an HSP90 inhibitor.

50. The anti-cancer agent for use of embodiment 49, wherein the HSP90 inhibitor comprises a benzoquinone or hygroquinone ansamycin HSP90 inhibitor.

51. The anti-cancer agent for use of embodiment 49, wherein the HSP90 inhibitor comprises one or more of 17-AAG (also known as tanespimycin or CNF-1010), 17-DMAG, AT-13387, AUY-922 (also known as VER-49009), BIIB-021 (CNF-2024), BIIB-028, CCT-018159, CCT-129397, CNF-1010, CU-0305, Geldanamycin, IPI-504, Macbecin I, Macbecin II, MPC-3100, PF-04928473 (SNX-2112), Pochonin, PU-H71, Radanamycin, Radicol, SanA, di-SanA, SNX-5422, STA-9090, or XL-888.

52. A method for screening for an agent that inhibits the expression or activity of a MEX3A-NTRK1 fusion polypeptide of embodiment 12 or 13, comprising:

optionally, determining if the MEX3A-NTRK1 fusion polypeptide, or a nucleic acid molecule encoding the MEX3A-NTRK1 fusion polypeptide, is present;

contacting the MEX3A-NTRK1 fusion polypeptide, or a host cell expressing the MEX3A-NTRK1 fusion polypeptide, with a candidate agent; and detecting a change in a parameter associated with the MEX3A-NTRK1 fusion polypeptide.

53. The method of embodiment 52, wherein said parameter is the expression or an activity of the MEX3A-NTRK1 fusion polypeptide.

54. The method of embodiment 52 or 53, further comprising comparing a value for the parameter to a reference value.

55. The method of any of embodiments 52-54, further comprising comparing a parameter obtained from contacting a sample with the candidate agent to the same parameter obtained from not contacting a sample with the candidate agent.

56. The method of any of embodiments 52-55, further comprising, if a decrease in the expression or activity of the MEX3A-NTRK1 fusion polypeptide is detected, identifying or classifying the candidate agent as an inhibitor.

57. The method of any of embodiments 52-56, wherein said contacting occurs in a cell-free system.

58. The method of any of embodiments 52-56, wherein said contacting is effected in vitro, ex vivo, or in vivo.

59. The method of any of embodiments 52-58, wherein said parameter is chosen from one or more of:

(i) direct binding of the candidate agent to the MEX3A-NTRK1 fusion polypeptide;
(ii) a change in an NTRK1 kinase activity;
(iii) a change in an activity of a cell containing the MEX3A-NTRK1 fusion polypeptide;
(iv) a change in a tumor present in an animal subject; or
(v) a change in the level of the MEX3A-NTRK1 fusion polypeptide or a nucleic acid molecule encoding the MEX3A-NTRK1 fusion polypeptide.

60. A method of determining the presence of a MEX3A-NTRK1 fusion nucleic acid molecule or a MEX3A-NTRK1 fusion polypeptide, comprising:

directly acquiring knowledge that the MEX3A-NTRK1 fusion nucleic acid molecule of embodiment 1 or 2, or the MEX3A-NTRK1 fusion polypeptide of embodiment 12 or 13, is present in a sample.

61. The method of embodiment 60, wherein said sample comprises fluid, cells, or tissue.

62. The method of embodiment 60, wherein the sample is a nucleic acid sample.

63. The method of embodiment 60, wherein the sample is a protein sample.

64. The method of any of embodiments 60-63, wherein the sample is acquired from a subject.

65. The method of embodiment 60, wherein the sample comprises a tumor biopsy, a circulating tumor cell, or a circulating tumor nucleic acid.

66. The method of any of embodiments 60-65, wherein the sample is from a cancer that has no detectable altered level or activity in one or more of EGFR, KRAS, ALK, ROS1 or RET.

67. The method of any of embodiments 60-66, wherein the sample is from a subject having an ovarian cancer.

68. The method of embodiment 67, wherein the ovarian cancer is an ovarian carcinosarcoma.

69. The method of any of embodiments 60-68, wherein the MEX3A-NTRK1 fusion nucleic acid molecule is detected.

70. The method of embodiment 69, wherein the MEX3A-NTRK1 fusion nucleic acid molecule is detected by a method chosen from one or more of: a nucleic acid hybridization assay, an amplification-based assay, a PCR-RFLP assay, real-time PCR, sequencing, a screening analysis, FISH, spectral karyotyping or MFISH, comparative genomic hybridization, in situ hybridization, sequence-specific priming (SSP) PCR, HPLC, or mass-spectrometric genotyping.

71. The method of embodiment 69 or 70, comprising acquiring a read for a nucleotide position in the MEX3A-NTRK1 fusion nucleic acid molecule by sequencing, thereby detecting that the MEX3A-NTRK1 fusion nucleic acid molecule is present.

72. The method of embodiment 71, wherein the read acquired is compared to a reference nucleotide sequence, optionally a wildtype MEX3A reference nucleotide sequence or a wildtype NTRK1 reference nucleotide sequence.

73. The method of any of embodiments 60-68, wherein the MEX3A-NTRK1 fusion polypeptide is detected.

74. The method of embodiment 73, comprising: contacting a sample with a reagent which specifically binds to the MEX3A-NTRK1 fusion polypeptide; and detecting the formation of a complex of the MEX3A-NTRK1 fusion polypeptide and the reagent.

75. The method of embodiment 74, wherein the reagent is labeled with a detectable moiety to facilitate detection of the bound and unbound reagent.

76. The method of embodiment 75, wherein the reagent is an antibody molecule.

77. A method of evaluating a subject, comprising:

identifying, selecting, or obtaining information or knowledge that the subject has participated in a clinical trial or has been treated for a cancer; and acquiring genotype information that identifies a MEX3A-NTRK1 fusion nucleic acid molecule or MEX3A-NTRK1 polypeptide in the subject, wherein the presence of the MEX3A-NTRK1 fusion nucleic acid molecule or MEX3A-NTRK1 fusion polypeptide identifies the subject as having an increased risk for, or having, a cancer associated with the MEX3A-NTRK1 fusion nucleic acid molecule or the MEX3A-NTRK1 fusion polypeptide.

78. The method of embodiment 77, further comprising providing a report to a party.

79. The method of embodiment 78, wherein the party is the subject, a caregiver, a physician, an oncologist, a hospital, a clinic, a third-party payor, an insurance company or a government office.

80. The method of embodiment 78 or 79, wherein said report is in electronic, web-based, or paper form.

81. The method of any of embodiments 78-80, wherein the report identifies the presence or absence of the MEX3A-NTRK1 fusion nucleic acid molecule or the MEX3A-NTRK1 fusion polypeptide, and optionally comprises an identifier for the subject from which the MEX3A-NTRK1 fusion nucleic acid molecule or the MEX3A-NTRK1 fusion polypeptide was obtained.

82. The method of any of embodiments 78-81, wherein said report comprises;

- information on the role of the MEX3A-NTRK1 fusion nucleic acid molecule or MEX3A-NTRK1 fusion polypeptide, in disease;
- information on prognosis, resistance, or potential or suggested therapeutic options;
- information on the likely effectiveness of a therapeutic option, the acceptability of a therapeutic option, or the advisability of applying the therapeutic option to a subject; or
- information, or a recommendation on, the administration of a drug.

83. A method for generating a personalized cancer treatment report, comprising:

- obtaining a sample from a subject, detecting a MEX3A-NTRK1 fusion nucleic acid molecule or a MEX3A-NTRK1 fusion polypeptide in the sample;
- selecting a treatment based on the MEX3A-NTRK1 fusion nucleic acid molecule or the MEX3A-NTRK1 fusion polypeptide detected; and
- providing a report comprising information on the MEX3A-NTRK1 fusion nucleic acid molecule or the MEX3A-NTRK1 fusion polypeptide detected and the treatment selected.

84. An isolated CARM1-NTRK3 fusion nucleic acid molecule comprising a nucleotide sequence chosen from:

(i) a nucleotide sequence comprising one or more, or all, of exons 1-3 of SEQ ID NO: 7 (CARM1) and one or more, or all, of exons 3-19 of SEQ ID NO: 9 (NTRK3), or a nucleotide sequence at least 70%, 75%, 80%, 85%, 90%, 91%, 92%, 93%, 94% 95%, 96%, 97%, 98%, 99%, or 99.5% identical thereto;

(ii) a nucleotide sequence comprising the nucleotide sequence of SEQ ID NO: 11, or a nucleotide sequence at least 70%, 75%, 80%, 85%, 90%, 91%, 92%, 93%, 94% 95%, 96%, 97%, 98%, 99%, or 99.5% identical thereto;

(iii) a nucleotide sequence encoding the amino acid sequence of SEQ ID NO: 12, or a nucleotide sequence at least 70%, 75%, 80%, 85%, 90%, 91%, 92%, 93%, 94% 95%, 96%, 97%, 98%, 99%, or 99.5% identical thereto;

(iv) a nucleotide sequence comprising all or a portion of the CARM1-NTRK3 fusion nucleic acid molecule Breakpoint 1 and/or Breakpoint 2 depicted in FIG. 1A; or (v) a fragment of any of (i)-(iv) comprising a nucleotide sequence from a CARM1 gene and a nucleotide sequence from an NTRK3 gene.

85. A nucleic acid molecule that is capable of hybridizing to the nucleic acid molecule of embodiment 84.

86. A fragment of the nucleic acid molecule of embodiment 84 or 85, wherein said fragment comprises between 10 and 25 nucleotides, or between 100 and 300 nucleotides.

87. The fragment of embodiment 86, which is a probe or primer that comprises between about 5 and 25 nucleotides.

88. The fragment of embodiment 86, which is a bait that comprises between about 100 and 300 nucleotides, 130 and 230 nucleotides, or 150 and 200 nucleotides.

89. A nucleic acid molecule suitable as a probe, primer, bait, or library member, that specifically binds to the nucleic acid molecule of embodiment 84 or 85, or the fragment of any of embodiments 86-88.

90. The nucleic acid molecule of embodiment 84 or 85, or the fragment of any of embodiments 86-88, which is operatively linked to a native or a heterologous regulatory nucleotide sequence.

91. A vector comprising a nucleic acid molecule of embodiment 84, 85, 89, or 90, or a fragment of any of embodiments 86-88.

92. A host cell comprising a vector of embodiment 91.

93. A nucleic acid molecule that specifically reduces or inhibits the expression, or alters a function, of the nucleic acid molecule of embodiment 84 or 85.

94. The nucleic acid molecule of embodiment 93, which is chosen from an antisense molecule, a ribozyme, an siRNA, a guide RNA (gRNA), or a triple helix molecule.

95. An isolated CARM1-NTRK3 fusion polypeptide comprising an amino acid sequence chosen from:

(i) the amino acid sequence encoded by exons 1-3 of SEQ ID NO: 7 (CARM1) and encoded by one or more, or all, of exons 3-19 of SEQ ID NO: 9 (NTRK3), or an amino acid sequence at least 70%, 75%, 80%, 85%, 90%, 91%, 92%, 93%, 94% 95%, 96%, 97%, 98%, 99%, or 99.5% identical thereto;

(ii) the amino acid sequence encoded by the nucleotide sequence of SEQ ID NO: 11, or an amino acid sequence at least 70%, 75%, 80%, 85%, 90%, 91%, 92%, 93%, 94% 95%, 96%, 97%, 98%, 99%, or 99.5% identical thereto;

(iii) the amino acid sequence of SEQ ID NO: 12, or an amino acid sequence at least 70%, 75%, 80%, 85%, 90%, 91%, 92%, 93%, 94% 95%, 96%, 97%, 98%, 99%, or 99.5% identical thereto;

(iv) the amino acid sequence encoded by a nucleotide sequence comprising all or a portion of a CARM1-NTRK3 fusion nucleic acid molecule Breakpoint 1 and/or Breakpoint 2 depicted in FIG. 1A; or (v) a fragment of any of (i)-(iv) comprising an amino acid sequence from a CARM1 polypeptide and an amino acid sequence from an NTRK3 polypeptide.

96. The polypeptide of embodiment 95, having a TRKA kinase activity, and/or a dimerizing or multimerizing activity.

97. An isolated antibody molecule that specifically binds to the polypeptide of embodiment 95 or 96.

98. A reaction mixture comprising:

a detection reagent capable of detecting a rearrangement associated with a CARM1 gene and/or an NTRK3 gene; and a target nucleic acid derived from a cancer, wherein the target nucleic acid comprises the nucleic acid molecule of any of embodiments 84-86.

99. The reaction mixture of embodiment 98, wherein the detection reagent detects the nucleotide sequence of a CARM1-NTRK3 fusion nucleic acid molecule.

100. The reaction mixture of embodiment 98 or 99, wherein the detection reagent distinguishes the nucleotide sequence of a CARM1-NTRK3 fusion nucleic acid molecule, from a wildtype CARM1 or NTRK3 nucleotide sequence, or the nucleotide sequence of a second CARM1 fusion nucleic acid molecule or NTRK3 fusion nucleic acid molecule.

101. The reaction mixture of any of embodiments 98-100, wherein the detection reagent comprises a DNA, RNA, or mixed DNA/RNA molecule comprising a nucleotide sequence that is complementary to a CARM1-NTRK3 fusion nucleic acid molecule.

102. The reaction mixture of any of embodiments 98-101, wherein the detection reagent detects the fusion junction of a CARM1-NTRK3 fusion nucleic acid molecule.

103. A method of making a reaction mixture comprising:

combining a detection reagent capable of detecting a rearrangement associated with a CARM1 gene and/or an NTRK3 gene with a target nucleic acid derived from a cancer, wherein the target nucleic acid comprises the nucleic acid molecule of any of embodiments 84, 85, 90, or 91, or the fragment of any of embodiments 86-88.

104. A preparation of the nucleic acid molecule of any of embodiments 84, 85, 90, or 91, or the fragment of any of embodiments 86-88, disposed in a sequencing device, or a sample holder for use in such a device.

105. A preparation of the nucleic acid molecule of any of embodiments 84, 85, 90, or 91, or the fragment of any of embodiments 86-88, disposed in a device for determining a physical or chemical property, or a sample holder for use in such a device.

106. A detection reagent comprising a DNA, RNA, or mixed DNA/RNA molecule, comprising a nucleotide sequence that is complementary to the nucleotide sequence of a CARM1-NTRK3 fusion nucleic acid molecule.

107. A kit comprising the detection reagent of embodiment 106 and instructions for use of the detection reagent to detect a CARM1-NTRK3 fusion nucleic acid molecule.

108 A reaction mixture, comprising:

a detection reagent capable of detecting a structural or functional property of a CARM1-NTRK3 fusion polypeptide; and a target protein derived from a cancer, wherein the target protein comprises the polypeptide of embodiment 95 or 96.

109. A method of making a reaction mixture, comprising:

combining a detection reagent capable of detecting a structural or functional property of a CARM1-NTRK3 fusion polypeptide; with a target protein derived from a cancer, wherein the target protein comprises the polypeptide of embodiment 95 or 96.

110. A kit comprising the antibody molecule of embodiment 97 and instructions for use of the antibody molecule to detect a CARM1-NTRK3 fusion polypeptide.

111. A method of reducing an activity or expression of the CARM1-NTRK3 fusion polypeptide of embodiment 95 or 96, comprising:

optionally, acquiring knowledge of the presence of the CARM1-NTRK3 fusion polypeptide; and contacting the CARM1-NTRK3 fusion polypeptide, or a cell expressing the CARM1-NTRK3 fusion polypeptide, with an agent that reduces an activity or expression of the CARM1-NTRK3 fusion polypeptide.

112. The method of embodiment 111, wherein the contacting step is effected in vitro.

113. The method of embodiment 111, wherein the contacting step is effected in vivo.

114. The method of embodiment 113, wherein the contacting step is effected in a human or animal subject.

115. An anti-cancer agent for use in treating a cancer in a subject, wherein the use comprises acquiring knowledge of the presence of the CARM1-NTRK3 fusion nucleic acid molecule of any of embodiments 84-86 or a CARM1-NTRK3 fusion polypeptide of embodiment 95 or 96 in the subject.

116. The anti-cancer agent for use of embodiment 115, wherein said anti-cancer agent comprises:

(i) a kinase inhibitor; and/or (ii) a methyl transferase inhibitor.

117. The anti-cancer agent for use of embodiment 116, wherein the kinase inhibitor and/or the methyl transferase inhibitor is administered responsive to a determination of the presence of the CARM1-NTRK3 fusion nucleic acid molecule or CARM1-NTRK3 fusion polypeptide in a sample from said subject.

118. The anti-cancer agent for use of any of embodiments 115-117, wherein said use is responsive to acquiring knowledge or information of the presence of the CARM1-NTRK3 fusion nucleic acid molecule or CARM1-NTRK3 fusion polypeptide in said subject.

119. The anti-cancer agent for use of any of embodiments 115-117, wherein said use is responsive to acquiring knowledge or information of the presence of the CARM1-NTRK3 fusion nucleic acid molecule or CARM1-NTRK3 fusion polypeptide in said subject from another party.

120. The anti-cancer agent for use of any of embodiments 115-117, wherein the use comprises receiving a communication of the presence of the CARM1-NTRK3 fusion nucleic acid molecule or CARM1-NTRK3 fusion polypeptide in the subject.

121. The anti-cancer agent for use of any of embodiments 115-117, wherein said use is responsive to an identification of the presence of the CARM1-NTRK3 fusion nucleic acid molecule or CARM1-NTRK3 fusion polypeptide in the subject, wherein said identification arises from collaboration with another party.

122. The anti-cancer agent for use of any of embodiments 115-117, comprising determining the presence of the CARM1-NTRK3 fusion nucleic acid molecule or CARM1-NTRK3 fusion polypeptide by sequencing.

123. The anti-cancer agent for use of any of embodiments 115-122, wherein said cancer is chosen from a melanoma, a salivary gland mammary analogue secretory carcinoma, a soft tissue fibrosarcoma, a salivary gland tumor, histiocytosis, a thyroid tumor, a soft tissue sarcoma, or a chondrosarcoma.

124. The anti-cancer agent for use of embodiment 123, wherein the cancer is melanoma.

125. The anti-cancer agent for use of embodiment 124, wherein the melanoma is a vaginal melanoma.

126. The anti-cancer agent for use of any of embodiments 115-125, wherein the cancer has no detectable altered level or activity in one or more of EGFR, KRAS, ALK, ROS1 or RET.

127. The anti-cancer agent for use of any of embodiments 115-126, wherein the anti-cancer agent comprises a kinase inhibitor that selectively inhibits a kinase activity of the CARM1-NTRK3 fusion polypeptide.

128. The anti-cancer agent for use of any of embodiments 115-127, wherein the anti-cancer agent comprises a kinase inhibitor chosen from one or more of: AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo [2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-Oil, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928.

129. The anti-cancer agent for use of embodiment 128, wherein the kinase inhibitor is ARRY-470 or larotrectinib, AZ-23, danusertib (PHA-739358), entrectinib, lestaurtinib (CEP-701), AZD7451, belizatinib, selitrectinib, or crizotinib.

130. The anti-cancer agent for use of any of embodiments 115-129, wherein the anti-cancer agent comprises a kinase inhibitor chosen from an antisense molecule, a ribozyme, an siRNA, a triple helix-forming oligonucleotide, or a gRNA, each of which hybridizes to a CARM1-NTRK3 fusion nucleic acid molecule, or a transcription regulatory region thereof.

131. The anti-cancer agent for use of any of embodiments 115-130, wherein the anti-cancer agent comprises a methyl transferase inhibitor that selectively inhibits a methyl transferase activity of the CARM1-NTRK3 fusion polypeptide.

132. The anti-cancer agent for use of any of embodiments 115-131, wherein the anti-cancer agent comprises a methyl transferase chosen from one or more of: EZM 2302 (EZM2302 or GSK 3359088); a PRMT4/CARM1 Inhibitor; or EPZ025654.

133. A method for screening for an agent that inhibits the expression or activity of a CARM1-NTRK3 fusion polypeptide of embodiment 95 or 96, comprising:

optionally, determining if the CARM1-NTRK3 fusion polypeptide, or a nucleic acid molecule encoding the CARM1-NTRK3 fusion polypeptide, is present;

contacting the CARM1-NTRK3 fusion polypeptide, or a host cell expressing the CARM1-NTRK3 fusion polypeptide, with a candidate agent; and detecting a change in a parameter associated with the CARM1-NTRK3 fusion polypeptide.

134. The method of embodiment 133, wherein said parameter is the expression or an activity of the CARM1-NTRK3 fusion polypeptide.

135. The method of embodiment 133 or 134, further comprising comparing a value for the parameter to a reference value.

136. The method of any of embodiments 133-135, further comprising comparing a parameter obtained from contacting a sample with the candidate agent to the same parameter obtained from not contacting a sample with the candidate agent.

137. The method of any of embodiments 133-136, further comprising, if a decrease in the expression or activity of the CARM1-NTRK3 fusion polypeptide is detected, identifying or classifying the candidate agent as an inhibitor.

138. The method of any of embodiments 133-137, wherein said contacting occurs in a cell-free system.

139. The method of any of embodiments 133-137, wherein said contacting is effected in vitro, ex vivo, or in vivo.

140. The method of any of embodiments 133-139, wherein said parameter is chosen from one or more of:

(i) direct binding of the candidate agent to the CARM1-NTRK3 fusion polypeptide;
(ii) a change in an NTRK3 kinase activity;
(iii) a change in an activity of a cell containing the CARM1-NTRK3 fusion polypeptide;
(iv) a change in a tumor present in an animal subject; or
(v) a change in the level of the CARM1-NTRK3 fusion polypeptide or a nucleic acid molecule encoding the CARM1-NTRK3 fusion polypeptide.

141. A method of determining the presence of a CARM1-NTRK3 fusion nucleic acid molecule or a CARM1-NTRK3 fusion polypeptide, comprising:

directly acquiring knowledge that the CARM1-NTRK3 fusion nucleic acid molecule of embodiment 84 or 85, or the CARM1-NTRK3 fusion polypeptide of embodiment 95 or 96, is present in a sample.

142. The method of embodiment 141, wherein said sample comprises fluid, cells, or tissue.

143. The method of embodiment 141, wherein the sample is a nucleic acid sample.

144. The method of embodiment 141, wherein the sample is a protein sample.

145. The method of any of embodiments 141-144, wherein the sample is acquired from a subject.

146. The method of embodiment 145, wherein the sample comprises a tumor biopsy, a circulating tumor cell, or a circulating tumor nucleic acid.

147. The method of any of embodiments 141-146, wherein the sample is from a cancer that has no detectable altered level or activity in one or more of EGFR, KRAS, ALK, ROS1 or RET.

148. The method of any of embodiments 141-147, wherein the sample is from a subject having a melanoma.

149. The method of embodiment 148, wherein the melanoma is a vaginal melanoma.

150. The method of any of embodiments 141-149, wherein the CARM1-NTRK3 fusion nucleic acid molecule is detected.

151. The method of embodiment 150, wherein the CARM1-NTRK3 fusion nucleic acid molecule is detected by a method chosen from one or more of: a nucleic acid hybridization assay, an amplification-based assay, a PCR-RFLP assay, real-time PCR, sequencing, a screening analysis, FISH, spectral karyotyping or MFISH, comparative genomic hybridization, in situ hybridization, sequence-specific priming (SSP) PCR, HPLC, or mass-spectrometric genotyping.

152. The method of embodiment 150 or 151, comprising acquiring a read for a nucleotide position in the CARM1-NTRK3 fusion nucleic acid molecule by sequencing, thereby detecting that the CARM1-NTRK3 fusion nucleic acid molecule is present.

153. The method of embodiment 152, wherein the read acquired is compared to a reference nucleotide sequence, optionally a wildtype CARM1 reference nucleotide sequence or a wildtype NTRK3 reference nucleotide sequence.

154. The method of any of embodiments 151-153, wherein the CARM1-NTRK3 fusion polypeptide is detected.

155. The method of embodiment 154, comprising: contacting the sample with a reagent which specifically binds to the CARM1-NTRK3 fusion polypeptide; and detecting the formation of a complex of the CARM1-NTRK3 fusion polypeptide and the reagent.

156. The method of embodiment 155, wherein the reagent is labeled with a detectable moiety to facilitate detection of the bound and unbound reagent.

157. The method of embodiment 156, wherein the reagent is an antibody molecule.

158. A method of evaluating a subject, comprising:

identifying, selecting, or obtaining information or knowledge that the subject has participated in a clinical trial or has been treated for a cancer; and acquiring genotype information that identifies a CARM1-NTRK3 fusion nucleic acid molecule or CARM1-NTRK3 polypeptide in the subject, wherein the presence of the CARM1-NTRK3 fusion nucleic acid molecule or CARM1-NTRK3 fusion polypeptide identifies the subject as having an increased risk for, or having, a cancer associated with the CARM1-NTRK3 fusion nucleic acid molecule or the CARM1-NTRK3 fusion polypeptide.

159. The method of embodiment 158, further comprising providing a report to a party.

160. The method of embodiment 159, wherein the party is the subject, a caregiver, a physician, an oncologist, a hospital, a clinic, a third-party payor, an insurance company or a government office.

161. The method of embodiment 159 or 160, wherein said report is in electronic, web-based, or paper form.

162. The method of any of embodiments 159-161, wherein the report identifies the presence or absence of the CARM1-NTRK3 fusion nucleic acid molecule or the CARM1-NTRK3 fusion polypeptide, and optionally comprises an identifier for the subject from which the CARM1-NTRK3 fusion nucleic acid molecule or the CARM1-NTRK3 fusion polypeptide was obtained.

163. The method of any of embodiments 159-162, wherein said report comprises;

information on the role of the CARM1-NTRK3 fusion nucleic acid molecule or CARM1-NTRK3 fusion polypeptide, in disease;

information on prognosis, resistance, or potential or suggested therapeutic options;

information on the likely effectiveness of a therapeutic option, the acceptability of a therapeutic option, or the advisability of applying the therapeutic option to a subject; or information, or a recommendation on, the administration of a drug.

164. A method for generating a personalized cancer treatment report, comprising:

obtaining a sample from a subject, detecting a CARM1-NTRK3 fusion nucleic acid molecule or a CARM1-NTRK3 fusion polypeptide in the sample;

selecting a treatment based on the CARM1-NTRK3 fusion nucleic acid molecule or the CARM1-NTRK3 fusion polypeptide detected; and providing a report comprising information on the CARM1-NTRK3 fusion nucleic acid molecule or the CARM1-NTRK3 fusion polypeptide detected and the treatment selected.

165. An isolated fusion nucleic acid molecule, wherein the isolated fusion nucleic acid is an NTRK1 fusion nucleic acid molecule comprising:

(i) a nucleotide sequence comprising one or more exons of a nucleotide sequence of Table A or a nucleotide sequence at least 70%, 75%, 80%, 85%, 90%, 91%, 92%, 93%, 94% 95%, 96%, 97%, 98%, 99%, or 99.5% identical thereto, and one or more exons of the nucleotide sequence of any of SEQ ID NOs: 3, 186, or 187 (NTRK1) or a nucleotide sequence at least 70%, 75%, 80%, 85%, 90%, 91%, 92%, 93%, 94% 95%, 96%, 97%, 98%, 99%, or 99.5% identical thereto;

(ii) a nucleotide sequence of Table C, or a nucleotide sequence at least 70%, 75%, 80%, 85%, 90%, 91%, 92%, 93%, 94% 95%, 96%, 97%, 98%, 99%, or 99.5% identical thereto;

(iii) a nucleotide sequence encoding an amino acid sequence of Table D, or a nucleotide sequence at least 70%, 75%, 80%, 85%, 90%, 91%, 92%, 93%, 94% 95%, 96%, 97%, 98%, 99%, or 99.5% identical thereto;

(iv) a nucleotide sequence comprising all or a portion of an NTRK1 fusion nucleic acid molecule comprising Breakpoint 1 and/or Breakpoint 2 of Table E or a rearrangement of Table E; or (v) a fragment of any of (i)-(iv) comprising a nucleotide sequence from a gene of Table A and a nucleotide sequence from an NTRK1 gene.

166. A nucleic acid molecule that is capable of hybridizing to the nucleic acid molecule of embodiment 165, comprising a nucleotide sequence that is complimentary to the nucleotide sequence of an NTRK1 fusion nucleic acid molecule comprising Breakpoint 1 and/or Breakpoint 2 of Table E or a rearrangement of Table E.

167. An isolated fusion nucleic acid molecule, wherein the isolated fusion nucleic acid is an NTRK2 fusion nucleic acid molecule comprising:

(i) a nucleotide sequence comprising one or more exons of a nucleotide sequence of Table F or a nucleotide sequence at least 70%, 75%, 80%, 85%, 90%, 91%, 92%, 93%, 94% 95%, 96%, 97%, 98%, 99%, or 99.5% identical thereto, and one or more exons of the nucleotide sequence of SEQ ID NO: 190 or SEQ ID NO: 194 (NTRK2) or a nucleotide sequence at least 70%, 75%, 80%, 85%, 90%, 91%, 92%, 93%, 94% 95%, 96%, 97%, 98%, 99%, or 99.5% identical thereto;

(ii) a nucleotide sequence of Table H, or a nucleotide sequence at least 70%, 75%, 80%, 85%, 90%, 91%, 92%, 93%, 94% 95%, 96%, 97%, 98%, 99%, or 99.5% identical thereto;

(iii) a nucleotide sequence encoding an amino acid sequence of Table I, or a nucleotide sequence at least 70%, 75%, 80%, 85%, 90%, 91%, 92%, 93%, 94% 95%, 96%, 97%, 98%, 99%, or 99.5% identical thereto;

(iv) a nucleotide sequence comprising all or a portion of an NTRK2 fusion nucleic acid molecule comprising Breakpoint 1 and/or Breakpoint 2 of Table J or a rearrangement of Table J; or (v) a fragment of any of (i)-(iv) comprising a nucleotide sequence from a gene of Table F and a nucleotide sequence from an NTRK2 gene.

168. A nucleic acid molecule that is capable of hybridizing to the nucleic acid molecule of embodiment 167, comprising a nucleotide sequence that is complimentary to the nucleotide sequence of an NTRK2 fusion nucleic acid molecule comprising Breakpoint 1 and/or Breakpoint 2 of Table J or a rearrangement of Table J.

169. An isolated fusion nucleic acid molecule, wherein the isolated fusion nucleic acid is an NTRK3 fusion nucleic acid molecule comprising:

(i) a nucleotide sequence comprising one or more exons of a nucleotide sequence of Table K or a nucleotide sequence at least 70%, 75%, 80%, 85%, 90%, 91%, 92%, 93%, 94% 95%, 96%, 97%, 98%, 99%, or 99.5% identical thereto, and one or more exons of the nucleotide sequence of any of SEQ ID NOs: 9 or 192 (NTRK3) or a nucleotide sequence at least 70%, 75%, 80%, 85%, 90%, 91%, 92%, 93%, 94% 95%, 96%, 97%, 98%, 99%, or 99.5% identical thereto;

(ii) a nucleotide sequence of Table M, or a nucleotide sequence at least 70%, 75%, 80%, 85%, 90%, 91%, 92%, 93%, 94% 95%, 96%, 97%, 98%, 99%, or 99.5% identical thereto;

(iii) a nucleotide sequence encoding an amino acid sequence of Table N, or a nucleotide sequence at least 70%, 75%, 80%, 85%, 90%, 91%, 92%, 93%, 94% 95%, 96%, 97%, 98%, 99%, or 99.5% identical thereto;

(iv) a nucleotide sequence comprising all or a portion of an NTRK3 fusion nucleic acid molecule comprising Breakpoint 1 and/or Breakpoint 2 of Table O or a rearrangement of Table O; or (v) a fragment of any of (i)-(iv) comprising a nucleotide sequence from a gene of Table K and a nucleotide sequence from an NTRK3 gene.

170. A nucleic acid molecule that is capable of hybridizing to the nucleic acid molecule of embodiment 169, comprising a nucleotide sequence that is complimentary to the nucleotide sequence of an NTRK3 fusion nucleic acid molecule comprising Breakpoint 1 and/or Breakpoint 2 of Table O or a rearrangement of Table O.

171. A vector comprising the nucleic acid molecule of any one of embodiments 165-170.

172. A host cell comprising the vector of embodiment 171.

173. An isolated fusion polypeptide, wherein the isolated fusion polypeptide is an NTRK1 fusion polypeptide comprising:

(i) an amino acid sequence encoded by one or more exons of a nucleotide sequence of Table A or an amino acid sequence at least 70%, 75%, 80%, 85%, 90%, 91%, 92%, 93%, 94% 95%, 96%, 97%, 98%, 99%, or 99.5% identical thereto, and an amino acid sequence encoded by one or more exons of the nucleotide sequence of any of SEQ ID NOs: 3, 186, or 187 (NTRK1) or an amino acid sequence at least 70%, 75%, 80%, 85%, 90%, 91%, 92%, 93%, 94% 95%, 96%, 97%, 98%, 99%, or 99.5% identical thereto;

(ii) an amino acid sequence encoded by a nucleotide sequence of Table C, or an amino acid sequence at least 70%, 75%, 80%, 85%, 90%, 91%, 92%, 93%, 94% 95%, 96%, 97%, 98%, 99%, or 99.5% identical thereto;

(iii) an amino acid sequence of Table D, or an amino acid sequence at least 70%, 75%, 80%, 85%, 90%, 91%, 92%, 93%, 94% 95%, 96%, 97%, 98%, 99%, or 99.5% identical thereto;

(iv) an amino acid sequence encoded by a nucleotide sequence comprising all or a portion of an NTRK1 fusion nucleic acid molecule comprising Breakpoint 1 and/or Breakpoint 2 of Table E or a rearrangement of Table E; or (v) a fragment of any of (i)-(iv) comprising an amino acid sequence of a polypeptide of Table B and an amino acid sequence of an NTRK1 polypeptide.

174. The polypeptide of embodiment 173, having a TRKA kinase activity, and/or a dimerizing or multimerizing activity.

175. An isolated antibody molecule that specifically binds to the polypeptide of embodiment 173 or embodiment 174.

176. An isolated fusion polypeptide, wherein the isolated fusion polypeptide is an NTRK2 fusion polypeptide comprising:

(i) an amino acid sequence encoded by one or more exons of a nucleotide sequence of Table F or an amino acid sequence at least 70%, 75%, 80%, 85%, 90%, 91%, 92%, 93%, 94% 95%, 96%, 97%, 98%, 99%, or 99.5% identical thereto, and an amino acid sequence encoded by one or more exons of the nucleotide sequence of SEQ ID NO: 190 or SEQ ID NO: 194 (NTRK2) or an amino acid sequence at least 70%, 75%, 80%, 85%, 90%, 91%, 92%, 93%, 94% 95%, 96%, 97%, 98%, 99%, or 99.5% identical thereto;

(ii) an amino acid sequence encoded by a nucleotide sequence of Table H, or an amino acid sequence at least 70%, 75%, 80%, 85%, 90%, 91%, 92%, 93%, 94% 95%, 96%, 97%, 98%, 99%, or 99.5% identical thereto;

(iii) an amino acid sequence of Table I, or an amino acid sequence at least 70%, 75%, 80%, 85%, 90%, 91%, 92%, 93%, 94% 95%, 96%, 97%, 98%, 99%, or 99.5% identical thereto;

(iv) an amino acid sequence encoded by a nucleotide sequence comprising all or a portion of an NTRK2 fusion nucleic acid molecule comprising Breakpoint 1 and/or Breakpoint 2 of Table J or a rearrangement of Table J; or (v) a fragment of any of (i)-(iv) comprising an amino acid sequence of a polypeptide of Table G and an amino acid sequence of an NTRK2 polypeptide.

177. The polypeptide of embodiment 176, having a TRKB kinase activity, and/or a dimerizing or multimerizing activity.

178. An isolated antibody molecule that specifically binds to the polypeptide of embodiment 176 or embodiment 177.

179. An isolated fusion polypeptide, wherein the isolated fusion polypeptide is an NTRK3 fusion polypeptide comprising:

(i) an amino acid sequence encoded by one or more exons of a nucleotide sequence of Table K or an amino acid sequence at least 70%, 75%, 80%, 85%, 90%, 91%, 92%, 93%, 94% 95%, 96%, 97%, 98%, 99%, or 99.5% identical thereto, and an amino acid sequence encoded by one or more exons of the nucleotide sequence of any of SEQ ID NOs: 9 or 192 (NTRK3) or an amino acid sequence at least 70%, 75%, 80%, 85%, 90%, 91%, 92%, 93%, 94% 95%, 96%, 97%, 98%, 99%, or 99.5% identical thereto;

(ii) an amino acid sequence encoded by a nucleotide sequence of Table M, or an amino acid sequence at least 70%, 75%, 80%, 85%, 90%, 91%, 92%, 93%, 94% 95%, 96%, 97%, 98%, 99%, or 99.5% identical thereto;

(iii) an amino acid sequence of Table N, or an amino acid sequence at least 70%, 75%, 80%, 85%, 90%, 91%, 92%, 93%, 94% 95%, 96%, 97%, 98%, 99%, or 99.5% identical thereto;

(iv) an amino acid sequence encoded by a nucleotide sequence comprising all or a portion of an NTRK3 fusion nucleic acid molecule comprising Breakpoint 1 and/or Breakpoint 2 of Table O or a rearrangement of Table O; or (v) a fragment of any of (i)-(iv) comprising an amino acid sequence of a polypeptide of Table L and an amino acid sequence of an NTRK3 polypeptide.

180. The polypeptide of embodiment 179, having a TRKC kinase activity, and/or a dimerizing or multimerizing activity.

181. An isolated antibody molecule that specifically binds to the polypeptide of embodiment 179 or embodiment 180.

182. A reaction mixture comprising a detection reagent capable of detecting a rearrangement associated with an NTRK1 gene and/or a gene of Table A, and a target nucleic acid derived from a cancer, wherein the target nucleic acid comprises the nucleic acid molecule of embodiment 165 or embodiment 166.

183. The reaction mixture of embodiment 182, wherein the detection reagent detects the nucleotide sequence of the nucleic acid molecule of embodiment 165 or embodiment 166.

184. The reaction mixture of embodiment 182 or embodiment 183, wherein the detection reagent distinguishes the nucleotide sequence of the nucleic acid molecule of embodiment 165 or embodiment 166 from the nucleotide sequence of a wild-type NTRK1 gene and/or of a wild-type gene of Table A, or wherein the detection reagent distinguishes the nucleotide sequence of a nucleic acid molecule of embodiment 165 or embodiment 166 from the nucleotide sequence of a second fusion nucleic acid molecule comprising all or a portion of the nucleotide sequence of an NTRK1 gene and/or all or a portion of the nucleotide sequence of a gene of Table A.

185. The reaction mixture of any one of embodiments 182-184, wherein the detection reagent comprises a DNA, RNA, or mixed DNA/RNA molecule comprising a nucleotide sequence that is complementary to a nucleotide sequence of a nucleic acid molecule of embodiment 165 or embodiment 166.

186. The reaction mixture of any one of embodiments 182-185, wherein the detection reagent detects the fusion junction of a nucleic acid molecule of embodiment 165 or embodiment 166.

187. A method of making a reaction mixture comprising: combining a detection reagent capable of detecting a rearrangement associated with an NTRK1 gene and/or a gene of Table A with a target nucleic acid derived from a cancer, wherein the target nucleic acid comprises the nucleic acid molecule of embodiment 165 or embodiment 166.

188. A reaction mixture comprising a detection reagent capable of detecting a rearrangement associated with an NTRK2 gene and/or a gene of Table F, and a target nucleic acid derived from a cancer, wherein the target nucleic acid comprises the nucleic acid molecule of embodiment 167 or embodiment 168.

189. The reaction mixture of embodiment 188, wherein the detection reagent detects the nucleotide sequence of the nucleic acid molecule of embodiment 167 or embodiment 168.

190. The reaction mixture of embodiment 188 or embodiment 189, wherein the detection reagent distinguishes the nucleotide sequence of a nucleic acid molecule of embodiment 167 or embodiment 168 from the nucleotide sequence of a wild-type NTRK2 gene and/or of a wild-type gene of Table F, or wherein the detection reagent distinguishes the nucleotide sequence of a nucleic acid molecule of embodiment 167 or embodiment 168 from the nucleotide sequence of a second fusion nucleic acid molecule comprising all or a portion of the nucleotide sequence of an NTRK2 gene and/or all or a portion of the nucleotide sequence of a gene of Table F.

191. The reaction mixture of any one of embodiments 188-190, wherein the detection reagent comprises a DNA, RNA, or mixed DNA/RNA molecule comprising a nucleotide sequence that is complementary to a nucleotide sequence of a nucleic acid molecule of embodiment 167 or embodiment 168.

192. The reaction mixture of any one of embodiments 188-191, wherein the detection reagent detects the fusion junction of a nucleic acid molecule of embodiment 167 or embodiment 168.

193. A method of making a reaction mixture comprising: combining a detection reagent capable of detecting a rearrangement associated with an NTRK2 gene and/or a gene of Table F with a target nucleic acid derived from a cancer, wherein the target nucleic acid comprises the nucleic acid molecule of embodiment 167 or embodiment 168.

194. A reaction mixture comprising a detection reagent capable of detecting a rearrangement associated with an NTRK3 gene and/or a gene of Table K, and a target nucleic acid derived from a cancer, wherein the target nucleic acid comprises the nucleic acid molecule of embodiment 169 or embodiment 170.

195. The reaction mixture of embodiment 194, wherein the detection reagent detects the nucleotide sequence of the nucleic acid molecule of embodiment 169 or embodiment 170.

196. The reaction mixture of embodiment 194 or embodiment 195, wherein the detection reagent distinguishes the nucleotide sequence of a nucleic acid molecule of embodiment 169 or embodiment 170 from the nucleotide sequence of a wild-type NTRK3 gene and/or of a wild-type gene of Table K, or wherein the detection reagent distinguishes the nucleotide sequence of a nucleic acid molecule of embodiment 169 or embodiment 170 from the nucleotide sequence of a second fusion nucleic acid molecule comprising all or a portion of the nucleotide sequence of an NTRK3 gene and/or all or a portion of the nucleotide sequence of a gene of Table K.

197. The reaction mixture of any one of embodiments 194-196, wherein the detection reagent comprises a DNA, RNA, or mixed DNA/RNA molecule comprising a nucleotide sequence that is complementary to a nucleotide sequence of a nucleic acid molecule of embodiment 169 or embodiment 170.

198. The reaction mixture of any one of embodiments 194-197, wherein the detection reagent detects the fusion junction of a nucleic acid molecule of embodiment 169 or embodiment 170.

199. A method of making a reaction mixture comprising: combining a detection reagent capable of detecting a rearrangement associated with an NTRK3 gene and/or a gene of Table K with a target nucleic acid derived from a cancer, wherein the target nucleic acid comprises the nucleic acid molecule of embodiment 169 or embodiment 170.

200. A preparation of the nucleic acid molecule of any one of embodiments 165-170, disposed in a sequencing device, or a sample holder for use in such a device.

201. A preparation of the nucleic acid molecule of any one of embodiments 165-170, disposed in a device for determining a physical or chemical property, or a sample holder for use in such a device.

202. A detection reagent comprising a DNA, RNA, or mixed DNA/RNA molecule, comprising a nucleotide sequence that is complementary to a nucleotide sequence of a nucleic acid molecule of embodiment 165 or embodiment 166.

203. A kit comprising the detection reagent of embodiment 202 and instructions for use of the detection reagent to detect a nucleic acid molecule of embodiment 165 or embodiment 166.

204. A detection reagent comprising a DNA, RNA, or mixed DNA/RNA molecule, comprising a nucleotide sequence that is complementary to the nucleotide sequence of a nucleic acid molecule of embodiment 167 or embodiment 168.

205. A kit comprising the detection reagent of embodiment 204 and instructions for use of the detection reagent to detect a nucleic acid molecule of embodiment 167 or embodiment 168.

206. A detection reagent comprising a DNA, RNA, or mixed DNA/RNA molecule, comprising a nucleotide sequence that is complementary to a nucleotide sequence of a nucleic acid molecule of embodiment 169 or embodiment 170.

207. A kit comprising the detection reagent of embodiment 206 and instructions for use of the detection reagent to detect a nucleic acid molecule of embodiment 169 or embodiment 170.

208. A reaction mixture, comprising:

(a) a detection reagent capable of detecting a structural or functional property of a fusion polypeptide of embodiment 173 or embodiment 174; and a target protein derived from a cancer, wherein the target protein comprises the polypeptide of embodiment 173 or embodiment 174;

(b) a detection reagent capable of detecting a structural or functional property of a fusion polypeptide of embodiment 176 or embodiment 177; and a target protein derived from a cancer, wherein the target protein comprises the polypeptide of embodiment 176 or embodiment 177; or (c) a detection reagent capable of detecting a structural or functional property of a fusion polypeptide of embodiment 179 or embodiment 180; and a target protein derived from a cancer, wherein the target protein comprises the polypeptide of embodiment 179 or embodiment 180.

209. A method of making a reaction mixture, comprising:

(a) combining a detection reagent capable of detecting a structural or functional property of a fusion polypeptide of embodiment 173 or embodiment 174 with a target protein derived from a cancer, wherein the target protein comprises the polypeptide of embodiment 173 or embodiment 174;

(b) combining a detection reagent capable of detecting a structural or functional property of a fusion polypeptide of embodiment 176 or embodiment 177 with a target protein derived from a cancer, wherein the target protein comprises the polypeptide of embodiment 176 or embodiment 177; or (c) combining a detection reagent capable of detecting a structural or functional property of a fusion polypeptide of embodiment 179 or embodiment 180 with a target protein derived from a cancer, wherein the target protein comprises the polypeptide of embodiment 179 or embodiment 180.

210. A kit comprising:

(a) the antibody molecule of embodiment 175 and instructions for use of the antibody molecule to detect a fusion polypeptide of embodiment 173 or embodiment 174;

(b) the antibody molecule of embodiment 178 and instructions for use of the antibody molecule to detect a fusion polypeptide of embodiment 176 or embodiment 177; or (c) the antibody molecule of embodiment 181 and instructions for use of the antibody molecule to detect a fusion polypeptide of embodiment 179 or embodiment 180.

211. A method of reducing an activity or expression of a fusion polypeptide, comprising:

(a) optionally, acquiring knowledge of the presence of a fusion polypeptide of embodiment 173 or embodiment 174; and contacting the fusion polypeptide of embodiment 173 or embodiment 174 or a cell expressing the fusion polypeptide of embodiment 173 or embodiment 174 with an agent that reduces an activity or expression of the fusion polypeptide of embodiment 173 or embodiment 174;

(b) optionally, acquiring knowledge of the presence of a fusion polypeptide of embodiment 176 or embodiment 177; and contacting the fusion polypeptide of embodiment 176 or embodiment 177 or a cell expressing the fusion polypeptide of embodiment 176 or embodiment 177 with an agent that reduces an activity or expression of the fusion polypeptide of embodiment 176 or embodiment 177; or (c) optionally, acquiring knowledge of the presence of a fusion polypeptide of embodiment 179 or embodiment 180; and contacting the fusion polypeptide of embodiment 179 or embodiment 180 or a cell expressing the fusion polypeptide of embodiment 179 or embodiment 180 with an agent that reduces an activity or expression of the fusion polypeptide of embodiment 179 or embodiment 180.

212. The method of embodiment 211, wherein the contacting step is effected in vitro.

213. The method of embodiment 211, wherein the contacting step is effected in vivo.

214. The method of embodiment 213, wherein the contacting step is effected in a human or animal subject.

215. An anti-cancer agent for use in treating a cancer in a subject, wherein the use comprises acquiring knowledge of the presence of a fusion nucleic acid molecule of any one of embodiments 165-170 or a fusion polypeptide of any one of embodiments 173-174, 176-177, or 179-180 in the subject.

216. A method for screening for an agent that inhibits the expression or activity of a fusion polypeptide of any one of embodiments 173-174, 176-177, or 179-180, comprising:
- optionally, determining if the fusion polypeptide of any one of embodiments 173-174, 176-177, or 179-180 or a nucleic acid molecule encoding the fusion polypeptide of any one of embodiments 173-174, 176-177, or 179-180 is present;
- contacting the fusion polypeptide of any one of embodiments 173-174, 176-177, or 179-180 or a host cell expressing the fusion polypeptide of any one of embodiments 173-174, 176-177, or 179-180 with a candidate agent; and
- detecting a change in a parameter associated with the fusion polypeptide.

217. A method of detecting the presence of a fusion nucleic acid molecule or of a fusion polypeptide, comprising:
- (a) detecting the fusion nucleic acid molecule of any one of embodiments 165-170 in a sample; or
- (b) detecting the fusion polypeptide of any one of embodiments 173-174, 176-177, or 179-180 in a sample.

218. The method of embodiment 217, wherein said sample comprises fluid, cells, or tissue.

219. The method of embodiment 217 or embodiment 218, wherein the sample comprises a tumor biopsy, a circulating tumor cell, or a circulating tumor nucleic acid.

220. The method of any one of embodiments 217-219, wherein the sample is acquired from a subject.

221. The method of any one of embodiments 217-220, wherein the sample is a nucleic acid sample.

222. The method of any one of embodiments 217-221, wherein the fusion nucleic acid molecule is detected in the sample by one or more methods selected from the group consisting of a nucleic acid hybridization assay, an amplification-based assay, a PCR-RFLP assay, real-time PCR, sequencing, a screening analysis, FISH, spectral karyotyping or MFISH, comparative genomic hybridization, in situ hybridization, sequence-specific priming (SSP) PCR, HPLC, and mass-spectrometric genotyping.

223. The method of any one of embodiments 217-220, wherein the sample is a protein sample.

224. The method of any one of embodiments 217-220 or embodiment 223, wherein the fusion polypeptide is detected in the sample by contacting the sample with a reagent which specifically binds to the fusion polypeptide of any one of embodiments 173-174, 176-177, or 179-180, and detecting the formation of a complex of the fusion polypeptide and the reagent.

225. A method of evaluating a subject, comprising:
- identifying, selecting, or obtaining information or knowledge that the subject has participated in a clinical trial or has been treated for a cancer; and
- acquiring genotype information that identifies a fusion nucleic acid molecule of any one of embodiments 165-170 or a fusion polypeptide of any one of embodiments 173-174, 176-177, or 179-180 in the subject,
- wherein the presence of the fusion nucleic acid molecule or of the fusion polypeptide identifies the subject as having an increased risk for, or having a cancer associated with the fusion nucleic acid molecule or the fusion polypeptide.

226. The method of embodiment 225, further comprising providing a report to a party.

227. The method of embodiment 226, wherein the party is the subject, a caregiver, a physician, an oncologist, a hospital, a clinic, a third-party payor, an insurance company or a government office.

228. The method of embodiment 226 or embodiment 227, wherein said report is in electronic, web-based, or paper form.

229. The method of any one of embodiments 226-228, wherein the report identifies the presence or absence of the fusion nucleic acid molecule or the fusion polypeptide, and optionally comprises an identifier for the subject from which the fusion nucleic acid molecule or the fusion polypeptide was obtained.

230. The method of any one of embodiments 226-229, wherein said report comprises;
- information on the role of the fusion nucleic acid molecule or the fusion polypeptide in disease;
- information on prognosis, resistance, or potential or suggested therapeutic options;
- information on the likely effectiveness of a therapeutic option, the acceptability of a therapeutic option, or the advisability of applying the therapeutic option to a subject; or
- information, or a recommendation on the administration of a drug.

231. A method for generating a personalized cancer treatment report, comprising:
- obtaining a sample from a subject, detecting a fusion nucleic acid molecule of any one of embodiments 165-170 or a fusion polypeptide of any one of embodiments 173-174, 176-177, or 179-180 in the sample;
- selecting a treatment based on the fusion nucleic acid molecule or the fusion polypeptide detected; and
- providing a report comprising information on the fusion nucleic acid molecule or the fusion polypeptide detected and the treatment selected.

232. A method of identifying an individual having cancer who may benefit from a treatment comprising a kinase inhibitor, the method comprising detecting a gene fusion in a sample from the individual, wherein the gene fusion is an NTRK1, NTRK2, or NTRK3 gene fusion, wherein:
- (i) the NTRK1 gene fusion comprises a fusion of an NTRK1 gene and a gene of Table A,
- (ii) the NTRK2 gene fusion comprises a fusion of an NTRK2 gene and a gene of Table F, or
- (iii) the NTRK3 gene fusion comprises a fusion of an NTRK3 gene and a gene of Table K;
- wherein the presence of the gene fusion in the sample identifies the individual as one who may benefit from the treatment comprising a kinase inhibitor.

233. A method of selecting a therapy for an individual having cancer, the method comprising detecting a gene fusion in a sample from the individual, wherein the gene fusion is an NTRK1, NTRK2, or NTRK3 gene fusion, wherein:
- (i) the NTRK1 gene fusion comprises a fusion of an NTRK1 gene and a gene of Table A,
- (ii) the NTRK2 gene fusion comprises a fusion of an NTRK2 gene and a gene of Table F, or
- (iii) the NTRK3 gene fusion comprises a fusion of an NTRK3 gene and a gene of Table K;
- wherein the presence of the gene fusion in the sample identifies the individual as one who may benefit from a treatment comprising a kinase inhibitor.

234. A method of identifying one or more treatment options for an individual having cancer, the method comprising:
(a) detecting a gene fusion in a sample from the individual, wherein the gene fusion is an NTRK1, NTRK2, or NTRK3 gene fusion, wherein:
(i) the NTRK1 gene fusion comprises a fusion of an NTRK1 gene and a gene of Table A,
(ii) the NTRK2 gene fusion comprises a fusion of an NTRK2 gene and a gene of Table F, or
(iii) the NTRK3 gene fusion comprises a fusion of an NTRK3 gene and a gene of Table K; and
(b) generating a report comprising one or more treatment options identified for the individual based at least in part on the presence of the gene fusion in the sample, wherein the one or more treatment options comprise a treatment comprising a kinase inhibitor.

235. A method of identifying one or more treatment options for an individual having cancer, the method comprising:
(a) acquiring knowledge of a gene fusion in a sample from the individual, wherein the gene fusion is an NTRK1, NTRK2, or NTRK3 gene fusion, wherein:
(i) the NTRK1 gene fusion comprises a fusion of an NTRK1 gene and a gene of Table A,
(ii) the NTRK2 gene fusion comprises a fusion of an NTRK2 gene and a gene of Table F, or
(iii) the NTRK3 gene fusion comprises a fusion of an NTRK3 gene and a gene of Table K; and
(b) generating a report comprising one or more treatment options identified for the individual based at least in part on said knowledge, wherein the one or more treatment options comprise a treatment comprising a kinase inhibitor.

236. A method of selecting a treatment for a subject having cancer, comprising acquiring knowledge of a gene fusion in a sample from a subject having cancer, wherein the gene fusion is an NTRK1, NTRK2, or NTRK3 gene fusion, wherein:
(i) the NTRK1 gene fusion comprises a fusion of an NTRK1 gene and a gene of Table A,
(ii) the NTRK2 gene fusion comprises a fusion of an NTRK2 gene and a gene of Table F, or
(iii) the NTRK3 gene fusion comprises a fusion of an NTRK3 gene and a gene of Table K;
wherein responsive to the acquisition of said knowledge: (i) the subject is classified as a candidate to receive a treatment comprising a kinase inhibitor; and/or (ii) the subject is identified as likely to respond to a treatment comprising a kinase inhibitor.

237. A method of treating or delaying progression of cancer, comprising administering to an individual an effective amount of a treatment comprising a kinase inhibitor, wherein the cancer comprises a gene fusion, wherein the gene fusion is an NTRK1, NTRK2, or NTRK3 gene fusion, wherein:
(i) the NTRK1 gene fusion comprises a fusion of an NTRK1 gene and a gene of Table A,
(ii) the NTRK2 gene fusion comprises a fusion of an NTRK2 gene and a gene of Table F, or
(iii) the NTRK3 gene fusion comprises a fusion of an NTRK3 gene and a gene of Table K.

238. A method of treating or delaying progression of cancer, comprising, responsive to knowledge of a gene fusion in a sample from an individual, administering to the individual an effective amount of a treatment comprising a kinase inhibitor, wherein the gene fusion is an NTRK1, NTRK2, or NTRK3 gene fusion, wherein:
(i) the NTRK1 gene fusion comprises a fusion of an NTRK1 gene and a gene of Table A,
(ii) the NTRK2 gene fusion comprises a fusion of an NTRK2 gene and a gene of Table F, or
(iii) the NTRK3 gene fusion comprises a fusion of an NTRK3 gene and a gene of Table K.

239. A method of treating or delaying progression of cancer, comprising:
(a) detecting a gene fusion in a sample from an individual, wherein the gene fusion is an NTRK1, NTRK2, or NTRK3 gene fusion, wherein:
(i) the NTRK1 gene fusion comprises a fusion of an NTRK1 gene and a gene of Table A,
(ii) the NTRK2 gene fusion comprises a fusion of an NTRK2 gene and a gene of Table F, or
(iii) the NTRK3 gene fusion comprises a fusion of an NTRK3 gene and a gene of Table K; and
(b) administering to the individual an effective amount of a treatment comprising a kinase inhibitor.

240. A method of treating or delaying progression of cancer, comprising:
(a) acquiring knowledge of a gene fusion in a sample from an individual, wherein the gene fusion is an NTRK1, NTRK2, or NTRK3 gene fusion, wherein:
(i) the NTRK1 gene fusion comprises a fusion of an NTRK1 gene and a gene of Table A,
(ii) the NTRK2 gene fusion comprises a fusion of an NTRK2 gene and a gene of Table F, or
(iii) the NTRK3 gene fusion comprises a fusion of an NTRK3 gene and a gene of Table K; and
(b) responsive to said knowledge, administering to the individual an effective amount of a treatment comprising a kinase inhibitor.

241. The method of any one of embodiments 232-240, wherein the gene fusion is an NTRK3 gene fusion, and wherein the cancer is selected from the group consisting of melanoma, a vaginal melanoma, a salivary gland mammary analogue secretory carcinoma, a soft tissue fibrosarcoma, a salivary gland tumor, a histiocytosis, a thyroid tumor, a thyroid carcinoma soft tissue sarcoma, a chondrosarcoma, an esophagus adenocarcinoma, a bladder adenocarcinoma, a breast carcinoma, a breast invasive ductal carcinoma (IDC), a uterus adenosarcoma, a pediatric soft tissue sarcoma, a liver cholangiocarcinoma, a brain glioblastoma, a primary leiomyosarcoma, a head and neck squamous cell carcinoma (HNSCC), a primary neuroendocrine tumor, a primary carcinoma, a primary adenocarcinoma, a soft tissue malignant peripheral nerve sheath tumor (MPNST), a soft tissue liposarcoma, a soft tissue leiomyosarcoma, a bone osteosarcoma, a salivary gland acinic tumor, a salivary gland adenocarcinoma, and a salivary gland carcinoma.

242. The method of any one of embodiments 232-240, wherein the gene fusion is an NTRK1 gene fusion, and wherein the cancer is selected from the group consisting of an ovarian cancer, a salivary gland tumor, a soft tissue fibrosarcoma, a histiocytosis, a thyroid tumor, a chondrosarcoma, a soft tissue sarcoma, an ovarian carcinosarcoma, a salivary gland mammary analogue secretory carcinoma, a primary serous carcinoma, a soft tissue angiosarcoma, a colon adenocarcinoma, a pediatric soft tissue sarcoma, a primary adenocarcinoma, a lung adenocarcinoma, a brain glioblastoma, a pancreas acinar cell carcinoma, a soft tissue liposarcoma, a thyroid papillary carcinoma, a thyroid carcinoma, a pediatric brain medulloblastoma, a lung sarcomatoid carcinoma, a prostate acinar adenocarcinoma, an ovary epithelial carcinoma, a pancreas ductal adenocarcinoma, an ovary serous carcinoma, a soft tissue myxofibrosarcoma, a primary sarcoma, a pediatric brain glioblastoma, a colorectal cancer, a rectal adenocarcinoma, a lung cancer, a non-small cell lung cancer (NSCLC), a sarcoma, a follicular dendritic cell sarcoma, a soft tissue sarcoma undifferentiated, a primary neuroendocrine tumor, a uterus adenosarcoma, a melanoma, a breast carcinoma, a primary carcinoma, a primary adenocarcinoma, a pancreatic cancer, and a brain medulloblastoma.

243. The method of any one of embodiments 232-240, wherein the gene fusion is an NTRK2 gene fusion, and wherein the cancer is selected from the group consisting of a duodenum adenocarcinoma, a breast carcinoma, a bladder urothelial carcinoma, a bladder transitional cell urothelial carcinoma, a pancreas ductal adenocarcinoma, a soft tissue sarcoma undifferentiated, a head and neck squamous cell carcinoma (HNSCC), a brain glioblastoma (GBM), a soft tissue liposarcoma, a bladder urothelial transitional cell carcinoma, a melanoma, a lung adenocarcinoma, a rectal adenocarcinoma, a primary neuroendocrine tumor, a primary adenocarcinoma, a primary carcinoma, a thyroid carcinoma, an ovary serous carcinoma, a colorectal cancer, and a colon adenocarcinoma.

244. The method of embodiment 241 or embodiment 242, wherein the cancer is a colorectal cancer, and the colorectal cancer comprises high microsatellite instability.

245. The method of any one of embodiments 241-244, wherein the cancer does not have an alteration in one or more of ALK, BRAF, ERBB2, EGFR, ROS1, or KRAS.

246. The method of any one of embodiments 241-245, wherein the cancer has no detectable altered level or activity of one or more of EGFR, KRAS, ALK, ROS1 or RET.

247. The method of any one of embodiments 241-246, wherein the cancer comprises a tumor mutation burden of 20 mut/mB or more.

248. The method of any one of embodiments 232-247, wherein the kinase inhibitor is selected from the group consisting of AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a]pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928.

249. The method of any one of embodiments 232-248, wherein the kinase inhibitor is larotrectinib, AZ-23, danusertib (PHA-739358), entrectinib, lestaurtinib (CEP-701), AZD7451, belizatinib, selitrectinib, or crizotinib.

250. The method of any one of embodiments 232-247, wherein the kinase inhibitor is selected from the group consisting of an antisense molecule, a ribozyme, an siRNA, a triple helix-forming oligonucleotide, and a gRNA.

251. The method of any one of embodiments 232-250, wherein the treatment comprising a kinase inhibitor further comprises a second therapeutic agent.

252. The method of any one of embodiments 232-241 or embodiments 244-251, wherein the gene fusion is an NTRK1 gene fusion, wherein the treatment comprising a kinase inhibitor further comprises an HSP90 inhibitor.

253. The method embodiment 252, wherein the HSP90 inhibitor comprises a benzoquinone HSP90 inhibitor or a hygroquinone ansamycin HSP90 inhibitor.

254. The method of embodiment 253, wherein the HSP90 inhibitor comprises one or more of 17-AAG, 17-DMAG, AT-13387, AUY-922, BIIB-021 (CNF-2024), BIIB-028, CCT-018159, CCT-129397, CNF-1010, CU-0305, Geldanamycin, IPI-504, Macbecin I, Macbecin II, MPC-3100, PF-04928473 (SNX-2112), Pochonin, PU-H71, Radanamycin, Radicol, SanA, di-SanA, SNX-5422, STA-9090, or XL-888.

255. A method of diagnosing and/or assessing an NTRK1, NTRK2, or NTRK3 gene fusion, the method comprising:

(a) detecting an NTRK1 gene fusion in a sample from an individual; and providing a diagnosis and/or assessment of an NTRK1 gene fusion, wherein the NTRK1 gene fusion comprises a fusion of an NTRK1 gene and a gene of Table A;

(b) detecting an NTRK2 gene fusion in a sample from an individual; and providing a diagnosis and/or assessment of an NTRK2 gene fusion, wherein the NTRK2 gene fusion comprises a fusion of an NTRK2 gene and a gene of Table F; or (c) detecting an NTRK3 gene fusion in a sample from an individual; and providing a diagnosis and/or assessment of an NTRK3 gene fusion, wherein the NTRK3 gene fusion comprises a fusion of an NTRK3 gene and a gene of Table K.

256. A kinase inhibitor for use in a method of treating or delaying progression of cancer, wherein the method comprises administering the kinase inhibitor to an individual, wherein an NTRK1, NTRK2, or NTRK3 gene fusion is detected in a sample obtained from the individual, wherein the (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K.

257. A kinase inhibitor for use in the manufacture of a medicament for treating or delaying progression of cancer, wherein the medicament is to be administered to an individual, wherein an NTRK1, NTRK2, or NTRK3 gene fusion has been detected in a sample obtained from the individual, wherein the (i) the NTRK1 gene fusion comprises a fusion of an NTRK1 gene and a gene of Table A, (ii) the NTRK2 gene fusion comprises a fusion of an NTRK2 gene and a gene of Table F, or (iii) the NTRK3 gene fusion comprises a fusion of an NTRK3 gene and a gene of Table K.

258. The kinase inhibitor of embodiment 256 or embodiment 257, wherein the kinase inhibitor is selected from the group consisting of AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo[1,5a]pyrimidine, a pyridocarbazole, a pyridoquinazolinyl, a pyridotriazole, a pyrrolidinyl thiourea, a pyrrolidinyl urea, a pyrrolo[2,3-d]pyrimidine, a quinazolinyl, repotrectinib, Ro 08-2750, a substituted pyrazolo[1,5a] pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, and VMD-928.

259. The kinase inhibitor of any one of embodiments 256-258, wherein the kinase inhibitor is larotrectinib, AZ-23, danusertib (PHA-739358), entrectinib, lestaurtinib (CEP-701), AZD7451, belizatinib, selitrectinib, or crizotinib.

260. In vitro use of one or more oligonucleotides for detecting:
- (a) an NTRK1 gene fusion, wherein the NTRK1 gene fusion comprises a fusion of an NTRK1 gene and a gene of Table A;
- (b) an NTRK2 gene fusion, wherein the NTRK2 gene fusion comprises a fusion of an NTRK2 gene and a gene of Table F; or
- (c) an NTRK3 gene fusion, wherein the NTRK3 gene fusion comprises a fusion of an NTRK3 gene and a gene of Table K.

261. A kit comprising one or more oligonucleotides for detecting:
- (a) an NTRK1 gene fusion, wherein the NTRK1 gene fusion comprises a fusion of an NTRK1 gene and a gene of Table A;
- (b) an NTRK2 gene fusion, wherein the NTRK2 gene fusion comprises a fusion of an NTRK2 gene and a gene of Table F; or
- (c) an NTRK3 gene fusion, wherein the NTRK3 gene fusion comprises a fusion of an NTRK3 gene and a gene of Table K.

INCORPORATION BY REFERENCE

Incorporated by reference herein in their entirety are any polynucleotide and polypeptide sequences which reference an accession number correlating to an entry in a public database, such as those maintained by the COSMIC database, available on the worldwide web at sanger.ac.uk/genetics/CGP/cosmic/; and the Institute for Genomic Research (TIGR) on the world wide web at tigr.org and/or the National Center for Biotechnology Information (NCBI) on the world wide web at ncbi.nlm.nih.gov. All citations throughout the disclosure are hereby expressly incorporated by reference.

EQUIVALENTS

Those skilled in the art will recognize or be able to ascertain using no more than routine experimentation, many equivalents to the specific embodiments described herein. Such equivalents are intended to be encompassed by the following claims.

SEQUENCE LISTING (209 sequences)

SEQ ID NO: 1 - DNA, 6480 bp, Artificial Sequence
  Synthetic Construct
aaaagagtttgagcgctggaaggggctgggctctattgggggccactgagcgccgctcccggactggggctcggtgcgggagcctaacgggggcgcctggacagcgggggctagagactcccaggtccgaggcgggaggggtgggggcagagatcctgcagccccccgccccccgtcacccccggagaggagaggagatctgctttcttggttttgcttctctttccccccacccccaccccgggggctggggcgaggggagtcgggttacagggtgtttggggaggggggcttagggggagggtctatctttctatctcgctttcttcccccctccccagttctttgttcccccctccccacacaccccctcctctcctctcccctcccctcctctctcctcttttcccttccaccacctctctctctctctctccctctctctctcccccagcttttgtttcgccatgcctagtctagtggtatctggaataatggaaagaaatgggggctttggagaactaggatgtttcgggggaagcgctaaggaccgagggctgctggaagacgagcgcgcccttcagctggctctcgatcaactctgcctcctgggtttgggggagccccccgcccccacggcgggcgaggacgggggaggtggggggggcggcgcccccgcgcagccggccgcccccccgcagccggccccgccgccgccgcccgcggcgcccccggccgccccgacggcggcccccgcagcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaaggstgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctctgcctcctcctcctcctcctcttccgccaaggcccgcgctgggcccccgggcgcacaccgctcccctgccacttccgcgggacccgagctggccggactcccgaggcgccccccgggagagccgctccagggcttctctaaacttggtgggggcggcctgcggagccccggcggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagagcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaaaagggagagggagaattaccacctgtatctagaggtgctctttgcaatccctaagccctctggtcctgacctccgacctcctaacatgaccctttacctcccaccccacccccatatcctgtttgggaaactgtcaccagtttccagcagtgtaagggagttggagtcctatcagaagttgcatagatcttctaggggttggggagagaagcatgtcaatcgtttctgtggctgaaaggctcagaagccatctgtccccacaaagctgggctagaggaatctggagaggagtcctcctctctgcccctgtcccctgcagtgtttcccttcactctctccgcctatcttcccttcctttgggatcttccctttcctcaactctttcctttccctccagctctttgctttgctttcttttggtggctgtcactcccagctctgtcttgttccttgtctttgtctttcttcccttccccctgcccctgcccctaccagcccagctttggggacaccatccttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttattgaatccttattagcttgaatccttattagcttgaatcctccatgcaaatcatggagtctgtgtcccacctgatgtggttgaggagaagccaggtcttcaaagaggggtcagcctggggcaaagcaggactggggggaggtgggcagcagggcctattctgagaatcacatattgttacaggccttgcaccccctttgctgcttccctcctgctcatttggggctgccaccagctctccaccctcctggttccgctggccgggccaagagaggatggagggatgggagtcccaggagatccttgtaaatagtggggtgggactgttctgagtgatcacccgagcacttaaagctccagagtcccattcttcctggatggagcaggtggaggtgcagaggggatttcctcctctccttcctcctgtcgagaattaacacctctccacagccttcccctccagaacaccagccagggaggggtggggaaggaggtcacagccaagaaaactgccctgtgacgacttccctccttcccgcctatgtgagccatcctgagatgtctgtacaatagaaaccaaaccaaatgggcaccctcggttgccggggggcaggtggggaggggggtgggaagaagggatgtctgtctgtcgtccccctccccctctccactctttacccacaaaggcagaagactgttacactagggggctcagcaaattcaatcccacccttaccaattgagccaaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataatttaatattctattttaataaaggcgtttattaccatataaatgtagcaaagaacctgggctaatatgaaaaaaaaagactttttattaggtaatttattatatgaaaaggatattttattttatgataaagtgatccttaaaaaaataaaaaaactttagaaggtttagaatatatgtagggagagaagaagaaaaaaatacatttgtattcagagttaaatcttaaaaaaaaaaagtgtttttaatatatgtttgggtttacgttgcttttttcccccactttttttttggggaggaatgtcatttgcttttcttgggggagcatcccgggggtgaatggtggagagaggagctgggggaacccggtccctcctgggacccttccagtagattggatttcactccatggactcctcctcccctctccccctccccctcaggggagccggcagagccaaacaaagaaagggattaacaagaaaggaagaagctgtaggactaaggactgaggatcctggggtgtcccccaccactttcccctgccctgtcgcaggggcaagtgaggagggggaatccagaattaaggcctagcaggcctataggaaccctcagagatgtgtgagatttaagagatctagatttttttttaaccaaaaacaagagagaaagagaagaaaaagagaaaccgaggggtttaaaagaaaagaatactacaaaataataattattaataataataattcaaatttatttcatataatcctagagagagaaagaaacaattactagttacttagtagacaatattaagatagcttaaagtttagtagcattgagggcccctgggtccagtagaatgtataaaagttgtaaggaaaagataaatagaggagggaagtggctgagtccaccctgagttgcccaatcttcagataccagggttggatcaggttgctagtttaagattgggagcttccagtctgctggggttgattctgagaatccttggatttttaaattgtaggacaaagaaatgaggggttcatttcccagggtcttggaaaggatgcacactgatcatctcaataagacaggggctgggttgggggcagcagaggaggccaagcacattcacctgcacccctagtacctgggcagcccatactccaatgtggtatgtcccctcctggggctcccagctcaaaccctcccatgcctgcttcccccaggcctaactgaggaagtccttcttgaagtgtgacctcggtccacttctctacagattgatttaagagcctgggaagtcattccacaaacagacacacatgcacacacgcttctcaccttcagagcttcaagagcactgaggcgatcagtcccctacccctgttcccatccagctttccacttagctttgacctccatggcagcagtagcagtaacaatctcagtaattgttctttaaagctgactcgttcttcacctacttgcaaagtgctttcttgtctcataaaagttagattccaagaaggacttcccacggagtggagtggaaacactgtccttgaaggcctgggagaaaggcatccccatgggcacagaggctggggaaaggcacagggactttgggtgaccctaaccctgaccctctgctccagttcacctccatctatatgtgttcaggtaggggtcatctactgtaccctggcctgggaacacattgccctccccacacaaaactggagggcttggcttctgcgtgtgagaaatcaacatttttaaagcacttgccttctaccaaccccagcttgcaatcactgggccttcccctcctatccaaggggttggaggggccccttggctctccttttggcaggaggagcctgcttcattacaccaatgactctgccatccccctccctggccctagaccccaaacacatctccctctacccaatttactcttctcgccccacctagggacagattccccctgctctttttgtcctagaaaccccgctagtttgggatggtagcgtctggggtggggagggcttccccttccccactcgagggtgcgggtggggaagggggggtgggtggagacagccctggggcagggaggatggtctctccactgtagaaagtagagtaggattgtggtcagacttaatttgaggcatctagtgaagacacgtacaaatccaccaaggaaaaagatttcaaaagcaaaataaaagcgggaaataaaacagacccaagaat

SEQ ID NO: 2 - protein, 520 aa, Artificial Sequence
  Synthetic Construct
MPSLVVSGIMERNGGFGELGCFGGSAKDRGLLEDERALQLALDQLCLLGLGEPPAPTAGEDGGGGGGGAPAQPAAPPQPAPPPPPAAPPAAPTAAPAAQTPQPPTAPKGASDAKLCALYKEAELRLKGSSNTTECVPVPTSEHVAEIVGRQGCKIKALRAKTNTYIKTPVRGEEPVFMVTGRREDVATARREIISAAEHFSMIRASRNKSGAAFGVAPALPGQVTIRVRVPYRVVGLVVGPKGATIKRIQQQTNTYIITPSRDRDPVFEITGAPGNVERAREEIETHIAVRTGKILEYNNENDFLAGSPDAAIDSRYSDAWRVHQPGCKPLSTFRQNSLGCIGECGVDSGFEAPRLGEQGGDFGYGGYLFPGYGVGKQDVYYGVAETSPPLWAGQENATPTSVLFSSASSSSSSSAKARAGPPGAHRSPATSAGPELAGLPRRPPGEPLQGFSKLGGGGLRSPGGGRDCMVCFESEVTAALVPCGHNLFCMECAVRICERTDPECPVCHITATQAIRIFS

SEQ ID NO: 3 - DNA, 2663 bp, Artificial Sequence
  Synthetic Construct
tgcagctgggagcgcacagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctagggggccggcccaggggctgggagtggttagccggaatactggggcctgccctcagcatcccccatagctcccagcagccccagggtgatctcaaagtatctaattcaccctcagcatgtgggaagggacaggtgggggctgggagtagaggatgttcctgcttctctaggcaaggtcccgtcatagcaattatatttattatcccttgaaaaaaaa

SEQ ID NO: 4 - protein, 796 aa, Artificial Sequence
  Synthetic Construct
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 5 - DNA, 1668 bp, Artificial Sequence
  Synthetic Construct
atgcctagtctagtggtatctggaataatggaaagaaatgggggctttggagaactaggatgtttcgggggaagcgctaaggaccgagggctgctggaagacgagcgcgcccttcagctggctctcgatcaactctgcctcctgggtttgggggagccccccgcccccacggcgggcgaggacgggggaggtggggggggcggcgcccccgcgcagccggccgcccccccgcagccggccccgccgccgccgcccgcggcgcccccggccgccccgacggcggcccccgcagcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaagtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 6 - protein, 555 aa, Artificial Sequence
  Synthetic Construct
MPSLVVSGIMERNGGFGELGCFGGSAKDRGLLEDERALQLALDQLCLLGLGEPPAPTAGEDGGGGGGGAPAQPAAPPQPAPPPPPAAPPAAPTAAPAAQTPQPPTAPKGASDAKLCALYKEAELRLKGSSNTTECVPVPTSEHVAEIVGRQLSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 7 - DNA, 3295 bp, Artificial Sequence
  Synthetic Construct
ctcggcctgcacggcggctgcggcggcggtagcggcagcggcggcggcggcggcggcggcggcggcggcggcggcggcggcggcggcagcggcggcggcctgggcccgggcgcagcggcggcggcggcggggcctggagccggatctaagatggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagttttatggctacctgtcccagcagcagaacatgatgcaggactacgtgcggacaggcacctaccagcgcgccatcctgcaaaaccacaccgacttcaaggacaagatcgttcttgatgttggctgtggctctgggatcctgtcgttttttgccgcccaagctggagcacggaaaatctacgcggtggaggccagcaccatggcccagcacgctgaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggaaacatgtttcctaccattggtgacgtccaccttgcacccttcacggatgaacagctctacatggagcagttcaccaaggccaacttctggtaccagccatctttccatggagtggacctgtcggccctccgaggtgccgcggtggatgagtatttccggcagcctgtggtggacacatttgacatccggatcctgatggccaagtctgtcaagtacacggtgaacttcttagaagccaaagaaggagatttgcacaggatagaaatcccattcaaattccacatgctgcattcagggctggtccacggcctggctttctggtttgacgttgctttcatcggctccataatgaccgtgtggctgtccacagccccgacagagcccctgacccactggtaccaggtgcggtgcctgttccagtcaccactgttcgccaaggcaggggacacgctctcagggacatgtctgcttattgccaacaaaagacagagctacgacatcagtattgtggcccaggtggaccagaccggctccaagtccagtaacctcctggatctgaaaaaccccttctttagatacacgggcacaacgccctcacccccacccggctcccactacacatctccctcggaaaacatgtggaacacgggcagcacctacaacctcagcagcgggatggccgtggcagggatgccgaccgcctatgacttgagcagtgttattgccagtggctccagcgtgggccacaacaacctgattcctttagccaacacggggattgtcaatcacacccactcccggatgggctccataatgagcacggggattgtccaagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctatgggaactgggacacttttttacacgatgttgccgccgtccccaccctaacccccacctcccggccctgagcgtgtgtcgctgccatattttacacaaaatcatgttgtgggagccctcgtcccccctcctgcccgctctaccctgacctgggcttgtcatctgctggaacaggcgccatggggcctgccagccctgcctgccaggtcccttagcacctgtccccctgcctgtctccagtgggaaggtagcctggccaggcggggcctccccttcgacgaccaggcctcggtcacaacggacgtgacatgctgctttttttaattttatttttttatgaaaagaaccagtgtcaatccgcagaccctctgtgaagccaggccggccgggccgagccagcagcccctctccctagactcagaggcgccgcggggaggggtggccccgccgaggcttcaggggccccctccccaccaaagggttcacctcacacttgaatgtacaacccaccccactgtcgggaaggcctccgtcctcggcccctgcctcttgctgctgtcctgtccccgagcccctgcaggtccccccccgcccccccactcaagagttagagcaggtggctgcaggccttgggcccggagggaaggccactgccggccacttggggcagacacagacacctcaaggatctgtcacggaaggcgtcctttttccttgtagctaacgttaggcctgagtagctcccctccatccttgtagacgctccagtccctactactgtgacggcatttccatccctcccctgcccgggaagggaccttgcagggacctctccctccaaaaaaagaaaaaaagaaaaagaaagaaaaaataaatgaggaaacgtgttgcagcacaggcagttttcttctccttctgctcccctgtttctcatacccccaaactcagatgctggagctcaggcccgccgtgtgtgcacccaggcaggagcgggcgctgtccaggctgggccgcccccttggctctccctcctgttccaggggagccataggagggaaagcaggtggcccgggggggatatgggggccccagccctgtcccaaagctccctgctcggctgcccctcgcccgcctttatataaattctctgaatcacctttgcatagaaaataaaagtgtttgctttgtaagaaaa

SEQ ID NO: 8 - protein, 608 aa, Artificial Sequence
  Synthetic Construct
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQFYGYLSQQQNMMQDYVRTGTYQRAILQNHTDFKDKIVLDVGCGSGILSFFAAQAGARKIYAVEASTMAQHAEVLVKSNNLTDRIVVIPGKVEEVSLPEQVDIIISEPMGYMLFNERMLESYLHAKKYLKPSGNMFPTIGDVHLAPFTDEQLYMEQFTKANFWYQPSFHGVDLSALRGAAVDEYFRQPVVDTFDIRILMAKSVKYTVNFLEAKEGDLHRIEIPFKFHMLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSVGHNNLIPLANTGIVNHTHSRMGSIMSTGIVQGSSGAQGSGGGSTSAHYAVNSQFTMGGPAISMASPMSIPTNTMHYGS

SEQ ID NO: 9 - DNA, 2962 bp, Artificial Sequence
  Synthetic Construct
acatttctgcagccgcgcggcgagccattcgcggcggctgctgcagctcctactgcatcttccttctcttcctttcctcgggctccggtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgctgaaggattttgcatctgatcgctcggcgtttcaaagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctagtggtggctggtggtcatgaattcatactctgttgcctcctctctccctgcctcacatctcccttccacctcacaactccttccatccttgactgaagcgaacatcttcatataaactcaagtgcctgctacacatacaacactgaaaaaaggaaaaaaaaagaaagaaaaaaaaaccc

SEQ ID NO: 10 - protein, 825 aa, Artificial Sequence
  Synthetic Construct
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 11 - DNA, 2946 bp, Artificial Sequence
  Synthetic Construct
atggcagcggcggcggcggcggtggggccgggcgcgggcggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccatgaagatgtgtgtgtctttaagtgctcagtgtcccgagagacagagtgcagccgtgtgggcaagcagtccttcatcatcaccctgggctgcaacagcgtcctcatccagttcgccacacccaacgatttctgttccttctacaacatcctgaaaacctgccggggccacaccctggagcggtctgtgttcagcgagcggacggaggagtcttctgccgtgcagtacttccagaagcagcgatcggagatggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 12 - protein, 981 aa, Artificial Sequence
  Synthetic Construct
MAAAAAAVGPGAGGAGSAVPGGAGPCATVSVFPGARLLTIGDANGEIQRHAEQQALRLEVRAGPDSAGIALYSHEDVCVFKCSVSRETECSRVGKQSFIITLGCNSVLIQFATPNDFCSFYNILKTCRGHTLERSVFSERTEESSAVQYFQKQRSEMDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 13 - DNA, 514 bp, Artificial Sequence
  Synthetic Construct
ccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctggtgcgagggccatcctgaaccctgcccccactcctgggctcctcctgggttacagccaacttcctgctatagccctgaccccagaaattggagtgcctggttcgggacagaaaggagtctggagtcctggtgtcccgctgttctggcctccttaccctctccccaagccaggactcctgaactcctgagctattccgtccttgtcggctggctgaggagacagccatgcagcagggcatcctggcccagctggaaaagggtcacatgcatcttcttccttgaggcccagcagcccacctccatcccccctcgtcccatgaaggaatgagtcccagagta

SEQ ID NO: 14 - DNA, 650 bp, Artificial Sequence
  Synthetic Construct
atactcagtctggcttcgagggccaggtctcccccaaagtctgtaactccaggcggctgggggccccagggatgccccctccccagcctaggagcagataccagagtacaggcttctgagtaactctttgcacattccgtcagtttttctggttaggagtggacaccccctcaggacagcctccctggattgggagaccgatcccctcccctttccctcttccagtgcgaggatatttctttgtctaaaggcagagtcctgggggaggaaggatctggagaaccgtcccgactaggggtaacggggaactttgtggcactttgaaatcagggtagggggcgggtccccctttgtggggaagggacagagccggaggcgggcaagaagggaagaaatgaactttccgcgctagggacgagggtgcccccactacagtccctctcagtggtcccggcgccccgcttaccttgcctgcccacgatctcggccacgtgctcggaggtgggcacgggaacacactccgtggtgttgctgctgcccttcaggcgcagctcggcctctttgtagagagcgcagagcttggcgtcgctcgcccctttgggggcggtggggggctggggcgtctgcgctgcgggggccgccgtcggggc

SEQ ID NO: 15 - DNA, 699 bp, Artificial Sequence
  Synthetic Construct
tcgcgcctcgccagggccggagtcacctggaatgcgcagccggagagcatctcccgagccagagcgagcctgacgcgcgcccagcgggcggcgggcagcggcgagctggggcgggcggagggccggctcccggccgcgggtgggcaggagggagacgcagagcgcgggggaggcaggctggggagcggccgcctgacttacatggaagtgatattccttgagatgtccgtgatgttgatactggcgttcccattgctgttccctgaatcctgcccttccaggagggggaagaggttcccatcgtccggccgccggcaattgatctcagtcttgctgcagacacaatttgcagggcaagccagcacggagcccacatagtccagccagacgcttcccagcaagaaaatccgccagaaactacacttggctgggcaaagagagacatccatctccgatcgctgcttctaaaaaagaggaggaggagaggagaggggggtggggtggggggagtggggagagcagggggggaaggaaacaaagacggcgagggaggggggaagggggagggggggcctctgcctttgaaacgccgagcgatcagatgcaaaatccttcagcgtctgaaaccatcgcggacgccgccgccgccgccgccgccgccgggtgggagccgcgaggagcgcctagtggcgcggtctg

SEQ ID NO: 16 - DNA, 651 bp, Artificial Sequence
  Synthetic Construct
ggaagccaggtctgcctgatgccaaagtctgtgcccctgcccaggtgccacgctgcctcccgatcgcccgttgtcttacagagagacaccacacctcacctgcctggcgctctgagttctagggctctgttcgatctgcttctcttcttctttggggccctcaagatgaggcaggtggcccccgatgccagaaccctgcctgtggcaaatcttgagttctcctgggcggcttccaggtccaggcggcatcagctgttgccatcggctgcagtgatagtggcggtgtcctcctgggggctgccctccggcttcctgctccctctcctggagctgctagtggggcccaggcagagggtgcacgacctcccgagggaggtttgtgccctagatggccccttgctctatcacagggctggccagggccttggctgcctcgtgccaccatgtgccccgtgccatcggtatgtctctgttccagttttatggctacctgtcccagcagcagaacatgatgcaggactacgtgcggacaggcacctaccagcgcgccatcctgcaaaaccacaccgacttcaaggacaaggtgagtggcccgcgcatgtgcccacctctctgcttctgtctcggttttttttttctttgctcattgat

SEQ ID NO: 17 - DNA, 2274 bp, Artificial Sequence
  Synthetic Construct
atgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagaggtgttacctgtgggcatcatagctggggccaccatcggcgcgagcatcctgctcatcttcttcttcatcgccttggtattcttcctctaccggcgccgcaaaggcagtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcgtcgtttaaggatgatgtggatctgaagcaggacctgcgctgcgacaccatcgacacccgggaggagtatgagatgaaggaccccaccaatggctactacaacgtgcgtgcccatgaagaccgcccgtcttccagggcagtgctctatgctgactaccgtgcccctggccctgcccgcttcgacggccgcccctcatcccgtctctcccactccagcggctatgcccagctcaacacctatagccggggccctgcctctgactatggccctgagcccacaccccctggccctgctgccccagctggcactgacacaaccagccagctgtcctacgagaactatgagaagttcaactcccatcccttccctggggcagctgggtaccccacctaccgactgggctacccccaggccccaccctctggcctggagcggaccccatatgaggcgtatgaccccattggcaagtacgccacagccactcgattctcctacacctcccagcactcggactacggccagcgattccagcagcgcatgcagactcacgtgtag

SEQ ID NO: 18 - DNA, 6087 bp, Artificial Sequence
  Synthetic Construct
atggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggaagttctccagcagctgattgtaatgaatttgcccaatgttttgatgattggcagagacccactgtctgggaagagcatggaggaaatcaagaaggtgctgctgctggtgctgggctgtgctgtccagtgtgagaggaaagaggagttcattgaaagaatcaaacagctggacattgagacccaggctggcatcgtggcccatatccaggaggtgactcacaaccaagagaacgtgtttgacctgcagtggctggagctgcccgacgtggctccggaggagctggaggccctgtcgaggagcatggtgctccacctgcggaggctcatcgaccagcgggacgagtgcaccgagctgatcgtggacctcactcaggaacgggactacctgcaggcacagcatccacccagccccatcaagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacgcctccaggaagtcgtttgtgtttgagctgaacgaatgtgcgtccagccgcatcctgaagctggagaaggagaatcagagcctccagagcaccatccaggggctgcgggacgcgtccctggtgttggaggagagcggcctcaagtgcggggagctggagaaggagaaccaccagctcagcaagaagattgaaaagttacaaacccagctggagagagaaaagcagagcaaccaagatctggagaccctcagtgaggagctgatcagagagaaggagcagctgcagagtgacatggagaccctgaaggctgacaaagccaggcagatcaaggaccttgagcaggaaaaggaccacctcaaccgagccatgtggtcgctgcgggagaggtcgcaggtcagcagtgaggcccgcatgaaagacgtggagaaggagaacaaagccctccaccagacggtgacggaggccaatggcaagctcagccagttggagtttgagaagcggcagctgcacagggacttggagcaggccaaggagaagggggagcgggcagagaagctggagagggagctacagcgactccaggaggagaacgggaggctggccaggaaggtgacctccctggagacagccaccgagaaagtcgaggccctggagcatgagagccagggcctgcagctggagaaccggactctgaggaagtctctggacaccttgcagaacgtgtccctgcagcttgagggcctggagcgtgacaacaagcagctggacgcagagaacctggagctgcgcaggctggtggagaccatgcgcttcaccagcaccaagctggcacagatggagagggagaaccagcagctggagcgtgagaaggaggagctgaggaagaacgtggatctgctcaaggcgctgggcaagaagtcagagcgcctggagctcagctaccagagcgtgagcgctgagaacctccggctgcagcagagcctggagagcagcagccacaagacgcagaccttggagagtgagctgggcgagctggaggctgagcgccaggcgctgcggcgggacctggaggccctccggctggccaatgcacagttggagggggccgagaaggacaggaaggccctggagcaggaggtggcccagctcgagaaggataagaagctgctggagaaggaggccaagcggctgtggcagcaggtggagctcaaggatgcagtcttggacgatagcactgccaaactgtccgccgttgagaaggagagccgcgcgctggacaaggagctggcccgctgcagggacgcagccggcaagctgaaggagctggagaaggacaaccgggacctcaccaagcaagtcaccgtgcatgcaaggacactgacaactctgagggaggacctggtgctcgagaagctgaagagccagcagctcagcagtgagctggacaagctgagccaggaactggagaaggtcggcctcaacagggagctgctgttgcaggaggacgacagcggcagtgacacaaaatacaagattttggagggcagaaatgaatcagcattaaaaacaacactagccatgaaagaagaaaagattgtgctcttagaagcacagatggaagagaaagcgagcctaaatcgccagttagagagtgagctgcagatgctaaagaaggagtgtgagaccctcaggcagaaccagggagaggggcagcacttgcagaactctttcaagcaccctgcggggaagacagccgccagtcaccaggggaaggaggcctgggggcccggccataaggaagccaccatggagcttctccgagtgaaggaccgggccatcgagctggagcggaataatgcagctctgcaggctgagaagcagctgctaaaggaacagctgcagcacctggagacccagaacgtgaccttcagcagccagatcttgacactgcagaaacagagcgccttcctgcaggagcacaacaccacactgcagacccagaccgccaagctgcaggtggagaactccacgctgagttcccagagcgcagcgctcaccgcgcagtacacgctgctgcagaaccaccacacggccaaggagacggagaacgaaagcctgcagaggcagcaggagcaacttacagcggcctacgaggccctgctgcaggaccacgagcacctgggcacgctgcacgagcggcaatcggccgagtacgaggccctcatccgccagcacagctgcctaaagacactgcatcggaatctggagctggagcacaaggagctcggggagaggcacggtgacatgctgaagcgcaaggcggagctggaggagcgggagaaggtcttgaccactgagcgagaggcgctgcagcaggagcagaggacaaacgccctcgccatgggcgagaaccagaggctgcggggcgagctggacagggtcaatttcctgcaccaccagctgaagggggagtacgaggagctgcacgcccacaccaaggagctgaaaacctcactgaacaacgcgcagctggagctcaaccgctggcaggcccgcttcgacgagctgaaggagcagcaccagaccatggacatctcgctgaccaagctggacaaccactgtgagctgctctcccgtctcaaggggaacttggaggaagaaaatcatcacctcctgagccagatccagctgttgagccagcagaaccagatgcttctggagcagaacatggagaacaaggagcagtaccatgaggagcagaagcagtacatagacaaattaaatgccttacgaagacataaggaaaagctggaagaaaaaatcatggatcaatacaagttctatgatcctcctccaaagaagaagaaccactggattggagccaaagccttagtcaaactcatcaaaccaaagaaagagggttcgagggaacgcttaaaatccaccgtggacagccctccctggcagctggagtcctcagaccccgcctcgccggcggcctctcagccgctcagatcacaggccgagaaccccgacacccccgcactgggctccaactgtgcagaagagcgcgacgcccacaacgggtctgtggggaaaggccctggggatctaaaaccaaagcgaggctccccacacagaggcagccttgaccgcacagatgcctccaccgatctggccatgaggtcctggccctcggagctgggctcccggacttgctcaacttcagccaccactacagccccttccaactccacccccatcgcccggcacccaggccgcaccaaaggctataactcagatgacaacctctgtgagccatccctggagtttgaggtccccaaccacaggcagtacgtgtcgcggccaagtagcttagagagcagtagaaacacatccagcaacagctcacctcttaacctaaaaggctcctccgagcagctccatggccggtctgagagcttcagcagcgaagacctgatccccagcagggacctggccactttgccccgggaagccagcacaccgggacgcaacgccctcggccgccacgagtaccccttgcctcggaacgggcctctcccacaggagggtgcccagaagaggggcacagcccctccctacgtcggagtgcggccctgctcggcctcccccagcagtgagatggtcaccttggaggagttcctggaggagagcaaccgcagctcccccacccatgacactcccagttgccgggatgacctgctgagtgactacttccgaaaggccagcgatcccccagccatcggaggccaaccaggaccacctgccaagaaagaaggggccaagatgcccaccaactttgtggcccccaccgtcaaaatggccgcccccacctcggaggggaggccgctgaagcccgggcagtacgtaaagccaaacttcagactgactgaggccgaggccccacccagcgtggccccgagacaggcccagcctccccagagcctgtctctgggcagaccccggcaggctccggtgcccccagcttcccatgcacctgccagccgcagtgcctccttgagccgggccttcagcctggcctcagctgaccttctccgggccagcgggccagaggcctgcaaacaggagtcccctcagaagctgggggctcctgaggccttagggggcagagagacaggcagccacaccctgcaaagccccgcaccccccagctcccatagcctggcccgggagcggaccccacttgtgggaaaggctggcagctcctgtcagggcccaggtccccgcagccggccgctggacacgaggcgcttctccctggctcccccaaaggaggagaggctggcccccctgcatcagtctgccacagcccccgccattgccactgcaggtgctggtgctgctgctgctggcagtggcagcaactcccagctcctgcacttctcacctgctgcagccccggctgccaggaccaagcccaaggcgcccccacgctcaggggaggtggccaccatcacccctgtccgggcagggctcagcctctcagagggagacggggtcccggggcagggctgcagtgaggggcttccggccaagagcccaggtcggtctcccgatttggctccccacctcggccgggccctggaggactgcagtcgagggagcgtctcaaagagcagtccggcctccccggagcccggcggggatccgcagaccgtgtggtatgagtacggctgtgtgtga

SEQ ID NO: 19 - DNA, 3837 bp, Artificial Sequence
  Synthetic Construct
atggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtgaagaacagcagcgaggagccatccctgggcaggctccagggtctgtgccaggcccagggctggtgaaggactcaccactgctgcttcagcagatctctgccatgaggctgcacatctcccagctccagcatgagaacagcatcctcaagggagcccagatgaaggcatccttggcatccctgccccctctgcatgttgcaaagctatcccatgagggccctggcagtgagttaccagctggagcgctgtatcgtaagaccagccagctgctggagacattgaatcaattgagcacacacacgcacgtagtagacatcactcgcaccagccctgctgccaagagcccgtcggcccaacttatggagcaagtggctcagcttaagtccctgagtgacaccgtcgagaagctcaaggatgaggtcctcaaggagacagtatctcagcgccctggagccacagtacccactgactttgccaccttcccttcatcagccttcctcagggccaaggaggagcagcaggatgacacagtctacatgggcaaagtgaccttctcatgtgcggctggttttggacagcgacaccggctggtgctgacccaggagcagctgcaccagcttcacagtcgcctcatctcctaa

SEQ ID NO: 20 - DNA, 2946 bp, Artificial Sequence
  Synthetic Construct
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtattattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaa

SEQ ID NO: 21 - DNA, 1146 bp, Artificial Sequence
  Synthetic Construct
atggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctga

SEQ ID NO: 22 - DNA, 3921 bp, Artificial Sequence
  Synthetic Construct
atgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagactttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcctggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggccaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcatag

SEQ ID NO: 23 - DNA, 822 bp, Artificial Sequence
  Synthetic Construct
atgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggaggaagaacgtgcaaaacgtgaggagctagagcgaatactggaagagaataaccgaaaaattgcagaagcacaagccaaactggccgaagaacagttgagaattgttgaagaacaaagaaagattcatgaggaaaggatgaaactagaacaagaacgacaacgtcaacaaaaagaagaacaaaaaattatcctgggcaaggggaagtccaggccaaaactgtccttctcattaaaaacccaggattaa

SEQ ID NO: 24 - DNA, 1563 bp, Artificial Sequence
  Synthetic Construct
atgcctagtctagtggtatctggaataatggaaagaaatgggggctttggagaactaggatgtttcgggggaagcgctaaggaccgagggctgctggaagacgagcgcgcccttcagctggctctcgatcaactctgcctcctgggtttgggggagccccccgcccccacggcgggcgaggacgggggaggtggggggggcggcgcccccgcgcagccggccgcccccccgcagccggccccgccgccgccgcccgcggcgcccccggccgccccgacggcggcccccgcagcgcagacgccccagccccccaccgcccccaaaggggcgagcgacgccaagctctgcgctctctacaaagaggccgagctgcgcctgaagggcagcagcaacaccacggagtgtgttcccgtgcccacctccgagcacgtggccgagatcgtgggcaggcaaggctgcaagattaaggccttgagggccaagaccaacacctacatcaagacaccggtgaggggcgaggaaccagtgttcatggtgacagggcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctctgcctcctcctcctcctcctcttccgccaaggcccgcgctgggcccccgggcgcacaccgctcccctgccacttccgcgggacccgagctggccggactcccgaggcgccccccgggagagccgctccagggcttctctaaacttggtgggggcggcctgcggagccccggcggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaa

SEQ ID NO: 25 - DNA, 2385 bp, Artificial Sequence
  Synthetic Construct
atgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaa

SEQ ID NO: 26 - DNA, 1578 bp, Artificial Sequence
  Synthetic Construct
atgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggctgtggggtcatgtccaaggctgacgccgccccctgctgacctgcctctggcattgccagcccatgggctatggagccgacacatcctgcagcagacactgatggacgaggggctgcggctcgcccgcctcgtctcccacgaccgcgtgggccgcctcagcccctgtgtgcctgcgaagccacctctcgcagagttcgaggaagggctgctggacagatgtcctgccccaggaccccatcccgcgctggtggagggtcgcaggagcagcgtgaaagtggaggctgaggccagccggcagtga

SEQ ID NO: 27 - DNA, 1449 bp, Artificial Sequence
  Synthetic Construct
atgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtga

SEQ ID NO: 28 - DNA, 2472 bp, Artificial Sequence
  Synthetic Construct
atggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatgatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatag

SEQ ID NO: 29 - DNA, 2121 bp, Artificial Sequence
  Synthetic Construct
atggacattaaacatcatcagaatggcacaagagggcaaagaagaaaacagcctcataccacggtgcagaggctcctgacctgggggctgccagtctcctgtagctggttcctgtggcgccagccgggcgagtttcctgtcactgctctcctgctgggggcaggcgctggggggctcctggccataggtctctttcagctcctggtgaaccccatgaacatctacgaagaacagaagattatgttcttgtacagcttggtgggcttgggggccatgggctgggggacctcccctcacatccgctgtgccagcctcctactagtacccaagatgctgggcaaggaaggcaggctctttgtcctgggatacgccttggctgccatctatgtggggccagtagccaatctgcgacacaatctcaacaacgtgatcgcatcgctgggctgcaccgtggagctgcagatcaacaacacccgcgcagcttggcgcatctccacagcccccttacgggccatgttcaaggacctgctgagtagcaaagaattgctgagagcagagactcggaacatctccgccacttttgaggacctggatgcccaggtgaatagtgagacgggctacacgcctgaggataccatggactcaggggagacagcccagggcagggaggcccgccaagccccagcctccagactccacctgtcgacacagaagatgtatgagctgaagaccaagctgcgttgctcctatgtggtgaaccaggccatactcagctgccgtcgttggtttgaccgcaagcatgaacagtgcatgaagcacatctgggtcccactcctcacccacctgctctgcctgcctatgaagttcaagttcttctgtggcattgccaaggtgatggaggtttggtgccgcaatcgcatcccagtggaaggcaactttgggcagacctacgactccctcaaccagtctattcgtggcctggatggggaattttcagccaatattgacttcaaggaagagaagcaggctggggtgctggggctcaacacaagctgggagcgcgtgagcaccgaggtgcgggactacgtgtaccgccaggaggcccggctggagtgggccctggggctgctgcacgtgctgctctcctgcactttcctgctggtcctgcatgcgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccgcgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtga

SEQ ID NO: 30 - DNA, 2670 bp, Artificial Sequence
  Synthetic Construct
atgagcaacccattcgcacaccttgctgagccattggatcctgtacaaccaggaaagaaattcttcaatttgaataaattggaggattcaagatatgggcgcttaccattttcgatcagagttcttctggaagcagccattcggaattgtgatgagtttttggtgaagaaacaggatattgaaaatattctacattggaatgtcacgcagcacaagaacatagaagtgccatttaagcctgctcgtgtcatcctgcaggactttacgggtgtgcccgctgtggttgactttgctgcaatgcgtgatgctgtgaaaaagttaggaggagatccagagaaaataaaccctgtctgccctgctgatcttgtaatagatcattccatccaggttgatttcaacagaagggcagacagtttacagaagaatcaagacctggaatttgaaagaaatagagagcgatttgaatttttaaagtggggttcccaggcttttcacaacatgcggattattccccctggctcaggaatcatccaccaggtgaatttggaatatttggcaagagtggtatttgatcaggatggatattattacccagacagcctcgtgggcacagactcgcacactaccatgattgatggcttgggcattcttggttggggtgtcggtggtattgaagcagaagctgtcatgctgggtcagccaatcagtatggtgcttcctcaggtgattggctacaggctgatggggaagccccaccctctggtaacatccactgacatcgtgctcaccattaccaagcacctccgccaggttggggtagtgggcaaatttgtcgagttcttcgggcctggagtagcccagttgtccattgctgaccgagctacgattgctaacatgtgtccagagtacggagcaactgctgcctttttcccagttgatgaagttagtatcacgtacctggtgcaaacaggtcgtgatgaagaaaaattaaagtatattaaaaaatatcttcaggctgtaggaatgtttcgagatttcaatgacccttctcaagacccagacttcacccaggttgtggaattagatttgaaaacagtagtgccttgctgtagtggacccaaaaggcctcaggacaaagttgctgtgtccgacatgaaaaaggactttgagagctgccttggagccaagcaaggatttaaaggattccaagttgctcctgaacatcataatgaccataagacctttatctatgataacactgaattcacccttgctcatggttctgtggtcattgctgccattactagctgcacaaacaccagtaatccgtctgtgatgttaggggcaggattgttagcaaagaaagctgtggatgctggcctgaacgtgatgccttacatcaaaactagcctgtctcctgggagtggcgtggtcacctactacctacaagaaagcggagtcatgccttatctgtctcagcttgggtttgacgtggtgggctatggctgcatgacctgcattggcaacagtgggcctttacctgaacctgtggtagaagccatcacacagggagaccttgtagctgttggagtactatctggaaacaggaattttgaaggtcgagttcaccccaacacccgggccaactatttagcctctccccccttagtaatagcatatgcaattgctggaaccatcagaatcgactttgagaaagagccattgggagtaaatgcaaagggacagcaggtatttctgaaagatatctggccgactagagacgagatccaggcagtggagcgtcagtatgtcatcccggggatgtttaaggaagtctatcagaaaatagagactgtgaatgaaagctggaatgccttagcaaccccatcagataagctgtttttctggaattccaaatctacgtatatcaaatcaccaccattctttgaaaacctgactttggatcttcagccccctaaatctatagtggatgcctatgtgctgctaaatttgggagattcggtaacaactgaccacatctccccagctggaaatattgcaagaaacagtcctgctgctcgctacttaactaacagaggcctaactccacgagaattcaactcctatggctcccgccgaggtaatgacgccgtcatggcacggggaacatttgccaacattcgcttgttaaacagatttttgaacaagcaggcaccacagactatccatctgccttctggggaaatccttgatgtgtttgatgctgctgagcggtaccagcaggcaggccttcccctgatcgttctggctggcaaagagtacggtgcaggcagctcccgagactgggcagctaagggccctttcctgctgggaatcaaagccgtcctggccgagagctacgagcgcattcaccgcagtaacctggttgggatgggtgtgatcccacttgaatatctccctggtgagaatgcagatgccctggggctcacagggcaagaacgatacactatcattattccagaaaacctcaaaccacaaatgaaagtccaggtcaagctggatactggcaagaccttccaggctgtcatgaggtttgacactgatgtggagctcacttatttcctcaacgggggcatcctcaactacatgatccgcaagatggccaagtag

SEQ ID NO: 31 - DNA, 717 bp, Artificial Sequence
  Synthetic Construct
atggcggcggctccgctgctgctgctgctgctgctcgtgcccgtgccgctgctgccgctgctggcccaagggcccggaggggcgctgggaaaccggcatgcggtgtactggaacagctccaaccagcacctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctag

SEQ ID NO: 32 - DNA, 1107 bp, Artificial Sequence
  Synthetic Construct
atgctttctaagaggggctgccatgcaagaatatatgctgattttcccatacggcgcctcatctcccagagatcttccttggagaccctggaagatattgaggagaacgcccctctccggagatgtcgaactctctcaggttcacccagaccaaagaattttaagaagattcattttatcaagaacatgcggcaacacgataccaggaatggcagaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctag

SEQ ID NO: 33 - DNA, 642 bp, Artificial Sequence
  Synthetic Construct
atggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctga

SEQ ID NO: 34 - DNA, 2280 bp, Artificial Sequence
  Synthetic Construct
atggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacagacctcggctgcccgacaactacacgcaggacacgtggcggaagctgcacgaggcggtgcgggccgtgcagagcagcacctccatcaggtacaacctcgaggagctctaccaggctgtggaaaatctctgttctcacaaagtctccccaatgctctacaagcaactgcgtcaggcctgtgaagaccacgtccaggcacagatccttccgtttagagaagactcactagatagtgttttatttttaaagaagattaacacgtgctggcaggaccactgcagacaaatgatcatgatcagaagcatcttcctgttcttggaccgcacctatgtgctgcagaactccacgctgccctccatctgggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgtataaagattcatttgaactgaaatttttggaagagactaattgcttatatgctgccgaaggccaaaggttaatgcaggaaagagaggttccagaatatcttaaccatgtaagtaaacgcttagaggaagagggagacagagtaatcacttacttggaccacagcacacagaaaccactgattgcttgtgtggagaaacagctattaggagaacatttaacagcaattctgcagaaagggctcgaccacttactggatgagaacagagtgccggacctcgcacagatgtaccagctgttcagccgggtgaggggcgggcagcaggcgctgctgcagcactggagcgagtacatcaagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcgcaaagcatgtggattcaaagttaagagcaggcaacaaagaagccacagacgaggagctggagcggacgttggacaagatcatgatcctgttcaggtttatccacggtaaagatgtctttgaagcattttataaaaaagatttggcaaaaagactccttgttgggaaaagtgcctcagtcgatgctgaaaagtctatgttgtcaaagctcaagcatgagtgcggtgcagccttcaccagcaagctggaaggcatgttcaaggacatggagctttcgaaggacatcatggttcatttcaagcagcatatgcagaatcagagtgactcaggccctatagacctcacagtgaacatactcacaatgggctactggccaacatacacgcccatggaagtgcacttaaccccagaaatgattaaacttcaggaagtatttaaggcattttatcttggaaagcacagtggtcgaaaacttcagtggcaaactactttgggacatgctgttttaaaagcggagtttaaagaagggaagaaggaattccaggtgtccctcttccagacactggtgctcctcatgttcaacgagggagatggcttcagctttgaggagataaaaatggccacggggatagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaagcctggagatttgaaaaagagaattgaatctctgatagacagagactatatggagagagacaaagacaatccgaatcagtaccactacgtggcctga

SEQ ID NO: 35 - DNA, 2514 bp, Artificial Sequence
  Synthetic Construct
atgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtga

SEQ ID NO: 36 - DNA, 504 bp, Artificial Sequence
  Synthetic Construct
atgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtag

SEQ ID NO: 37 - DNA, 1935 bp, Artificial Sequence
  Synthetic Construct
atggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccagtggtgaaatagggccttctaaacctgtggagaagtga

SEQ ID NO: 38 - DNA, 3051 bp, Artificial Sequence
  Synthetic Construct
atgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttga

SEQ ID NO: 39 - DNA, 2124 bp, Artificial Sequence
  Synthetic Construct
atgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttag

SEQ ID NO: 40 - DNA, 1521 bp, Artificial Sequence
  Synthetic Construct
atgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagcttcttttattgcagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtag

SEQ ID NO: 41 - DNA, 303 bp, Artificial Sequence
  Synthetic Construct
atgagagccctcacactcctcgccctattggccctggccgcactttgcatcgctggccaggcaggtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctag

SEQ ID NO: 42 - protein, 757 aa, Artificial Sequence
  Synthetic Construct
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 43 - protein, 2028 aa, Artificial Sequence
  Synthetic Construct
MDVTVSELLELFLQSPLVTWVKTFGPFGSGSQDNLTMYMDLVDGIFLNQIMLQIDPRPTNQRINKHVNNDVNLRIQNLTILVRNIKTYYQEVLQQLIVMNLPNVLMIGRDPLSGKSMEEIKKVLLLVLGCAVQCERKEEFIERIKQLDIETQAGIVAHIQEVTHNQENVFDLQWLELPDVAPEELEALSRSMVLHLRRLIDQRDECTELIVDLTQERDYLQAQHPPSPIKSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDASRKSFVFELNECASSRILKLEKENQSLQSTIQGLRDASLVLEESGLKCGELEKENHQLSKKIEKLQTQLEREKQSNQDLETLSEELIREKEQLQSDMETLKADKARQIKDLEQEKDHLNRAMWSLRERSQVSSEARMKDVEKENKALHQTVTEANGKLSQLEFEKRQLHRDLEQAKEKGERAEKLERELQRLQEENGRLARKVTSLETATEKVEALEHESQGLQLENRTLRKSLDTLQNVSLQLEGLERDNKQLDAENLELRRLVETMRFTSTKLAQMERENQQLEREKEELRKNVDLLKALGKKSERLELSYQSVSAENLRLQQSLESSSHKTQTLESELGELEAERQALRRDLEALRLANAQLEGAEKDRKALEQEVAQLEKDKKLLEKEAKRLWQQVELKDAVLDDSTAKLSAVEKESRALDKELARCRDAAGKLKELEKDNRDLTKQVTVHARTLTTLREDLVLEKLKSQQLSSELDKLSQELEKVGLNRELLLQEDDSGSDTKYKILEGRNESALKTTLAMKEEKIVLLEAQMEEKASLNRQLESELQMLKKECETLRQNQGEGQHLQNSFKHPAGKTAASHQGKEAWGPGHKEATMELLRVKDRAIELERNNAALQAEKQLLKEQLQHLETQNVTFSSQILTLQKQSAFLQEHNTTLQTQTAKLQVENSTLSSQSAALTAQYTLLQNHHTAKETENESLQRQQEQLTAAYEALLQDHEHLGTLHERQSAEYEALIRQHSCLKTLHRNLELEHKELGERHGDMLKRKAELEEREKVLTTEREALQQEQRTNALAMGENQRLRGELDRVNFLHHQLKGEYEELHAHTKELKTSLNNAQLELNRWQARFDELKEQHQTMDISLTKLDNHCELLSRLKGNLEEENHHLLSQIQLLSQQNQMLLEQNMENKEQYHEEQKQYIDKLNALRRHKEKLEEKIMDQYKFYDPPPKKKNHWIGAKALVKLIKPKKEGSRERLKSTVDSPPWQLESSDPASPAASQPLRSQAENPDTPALGSNCAEERDAHNGSVGKGPGDLKPKRGSPHRGSLDRTDASTDLAMRSWPSELGSRTCSTSATTTAPSNSTPIARHPGRTKGYNSDDNLCEPSLEFEVPNHRQYVSRPSSLESSRNTSSNSSPLNLKGSSEQLHGRSESFSSEDLIPSRDLATLPREASTPGRNALGRHEYPLPRNGPLPQEGAQKRGTAPPYVGVRPCSASPSSEMVTLEEFLEESNRSSPTHDTPSCRDDLLSDYFRKASDPPAIGGQPGPPAKKEGAKMPTNFVAPTVKMAAPTSEGRPLKPGQYVKPNFRLTEAEAPPSVAPRQAQPPQSLSLGRPRQAPVPPASHAPASRSASLSRAFSLASADLLRASGPEACKQESPQKLGAPEALGGRETGSHTLQSPAPPSSHSLARERTPLVGKAGSSCQGPGPRSRPLDTRRFSLAPPKEERLAPLHQSATAPAIATAGAGAAAAGSGSNSQLLHFSPAAAPAARTKPKAPPRSGEVATITPVRAGLSLSEGDGVPGQGCSEGLPAKSPGRSPDLAPHLGRALEDCSRGSVSKSSPASPEPGGDPQTVWYEYGCV

SEQ ID NO: 44 - protein, 1278 aa, Artificial Sequence
  Synthetic Construct
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 45 - protein, 981 aa, Artificial Sequence
  Synthetic Construct
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSGTEKKKEKPQGQREKKEESHSNDQSPQIRASPSPQPSSQPLQIHRQTPESKNATPTKSIKRPSPAEKSHNSWENSDDSRNKLSKIPSTPKLIPKVTKTADKHKDVIINQEGEYIKMFMRGRPITMFIPSDVDNYDDIRTELPPEKLKLEWAYGYRGKDCRANVYLLPTGKIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCIIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIDGTFLAVGSHDNFIYLYVVSENGRKYSRYGRCTGHSSYITHLDWSPDNKYIMSNSGDYEILYWDIPNGCKLIRNRSDCKDIDWTTYTCVLGFQVFGVWPEGSDGTDINALVRSHNRKVIAVADDFCKVHLFQYPCSKAKAPSHKYSAHSSHVTNVSFTHNDSHLISTGGKDMSIIQWKLVEKLSLPQNETVADTTLTKAPVSSTESVIQSNTPTPPPSQPLNETAEEESRISSSPTLLENSLEQTVEPSEDHSEEESEEGSGDLGEPLYEEPCNEISKEQAKATLLEDQQDPSPSS

SEQ ID NO: 46 - protein, 381 aa, Artificial Sequence
  Synthetic Construct
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 47 - protein, 1306 aa, Artificial Sequence
  Synthetic Construct
MTMYLWLKLLAFGFAFLDTEVFVTGQSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKCRPPRDRNGPHERYHLEVEAGNTLVRNESHKNCDFRVKDLQYSTDYTFKAYFHNGDYPGEPFILHHSTSYNSKALIAFLAFLIIVTSIALLVVLYKIYDLHKKRSCNLDEQQELVERDDEKQLMNVEPIHADILLETYKRKIADEGRLFLAEFQSIPRVFSKFPIKEARKPFNQNKNRYVDILPYDYNRVELSEINGDAGSNYINASYIDGFKEPRKYIAAQGPRDETVDDFWRMIWEQKATVIVMVTRCEEGNRNKCAEYWPSMEEGTRAFGDVVVKINQHKRCPDYIIQKLNIVNKKEKATGREVTHIQFTSWPDHGVPEDPHLLLKLRRRVNAFSNFFSGPIVVHCSAGVGRTGTYIGIDAMLEGLEAENKVDVYGYVVKLRRQRCLMVQVEAQYILIHQALVEYNQFGETEVNLSELHPYLHNMKKRDPPSEPSPLEAEFQRLPSYRSWRTQHIGNQEENKSKNRNSNVIPYDYNRVPLKHELEMSKESEHDSDESSDDDSDSEEPSKYINASFIMSYWKPEVMIAAQGPLKETIGDFWQMIFQRKVKVIVMLTELKHGDQEICAQYWGEGKQTYGDIEVDLKDTDKSSTYTLRVFELRHSKRKDSRTVYQYQYTNWSVEQLPAEPKELISMIQVVKQKLPQKNSSEGNKHHKSTPLLIHCRDGSQQTGIFCALLNLLESAETEEVVDIFQVVKALRKARPGMVSTFEQYQFLYDVIASTYPAQNGQVKKNNHQEDKIEFDNEVDKVKQDANCVNPLGAPEKLPEAKEQAEGSEPTSGTEGPEHSVNGPASPALNQGS

SEQ ID NO: 48 - protein, 273 aa, Artificial Sequence
  Synthetic Construct
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREEEERAKREELERILEENNRKIAEAQAKLAEEQLRIVEEQRKIHEERMKLEQERQRQQKEEQKIILGKGKSRPKLSFSLKTQD

SEQ ID NO: 49 - protein, 520 aa, Artificial Sequence; identical to SEQ ID NO: 2
  Synthetic Construct

SEQ ID NO: 50 - protein, 794 aa, Artificial Sequence
  Synthetic Construct
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPALTAIEGTAHGEPCHFPFLFLDKEYDECTSDGREDGRLWCATTYDYKADEKWGFCETEEEAAKRRQMQEAEMMYQTGMKILNGSNKKSQKREAYRYLQKAASMNHTKALERVSYALLFGDYLPQNIQAAREMFEKLTEEGSPKGQTALGFLYASGLGVNSSQAKALVYYTFGALGGNLIAHMVLGYRYWAGIGVLQSCESALTHYRLVANHVASDISLTGGSVVQRIRLPDEVENPGMNSGMLEEDLIQYYQFLAEKGDVQAQVGLGQLHLHGGRGVEQNHQRAFDYFNLAANAGNSHAMAFLGKMYSEGSDIVPQSNETALHYFKKAADMGNPVGQSGLGMAYLYGRGVQVNYDLALKYFQKAAEQGWVDGQLQLGSMYYNGIGVKRDYKQALKYFNLASQGGHILAFYNLAQMHASGTGVMRSCHTAVELFKNVCERGRWSERLMTAYNSYKDGDYNAAVIQYLLLAEQGYEVAQSNAAFILDQREASIVGENETYPRALLHWNRAASQGYTVARIKLGDYHFYGFGTDVDYETAFIHYRLASEQQHSAQAMFNLGYMHEKGLGIKQDIHLAKRFYDMAAEASPDAQVPVFLALCKLGVVYFLQYIRETNIRDMFTQLDMDQLLGPEWDLYLMTIIALLLGTVIAYRQRQHQDMPAPRPPGPRPAPPQQEGPPEQQPPQ

SEQ ID NO: 51 - protein, 525 aa, Artificial Sequence
  Synthetic Construct
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQAVGSCPRLTPPPADLPLALPAHGLWSRHILQQTLMDEGLRLARLVSHDRVGRLSPCVPAKPPLAEFEEGLLDRCPAPGPHPALVEGRRSSVKVEAEASRQ

SEQ ID NO: 52 - protein, 482 aa, Artificial Sequence
  Synthetic Construct
MPPSPLDDRVVVALSRPVRPQDLNLCLDSSYLGSANPGSNSHPPVIATTVVSLKAANLTYMPSSSGSARSLNCGCSSASCCTVATYDKDNQAQTQAIAAGTTTTAIGTSTTCPANQMVNNNENTGSLSPSSGVGSPVSGTPKQLASIKIIYPNDLAKKMTKCSKSHLPSQGPVIIDCRPFMEYNKSHIQGAVHINCADKISRRRLQQGKITVLDLISCREGKDSFKRIFSKEIIVYDENTNEPSRVMPSQPLHIVLESLKREGKEPLVLKGGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 53 - protein, 823 aa, Artificial Sequence
  Synthetic Construct
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 54 - protein, 706 aa, Artificial Sequence
  Synthetic Construct
MDIKHHQNGTRGQRRKQPHTTVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPRHPLADILHRGCPLLRRWLCRRCVVCQAPETPESYVCRTLDCEAVYCWSCWDDMRQRCPVCTPREELSSSAFSDSNDDTAYAG

SEQ ID NO: 55 - protein, 889 aa, Artificial Sequence
  Synthetic Construct
MSNPFAHLAEPLDPVQPGKKFFNLNKLEDSRYGRLPFSIRVLLEAAIRNCDEFLVKKQDIENILHWNVTQHKNIEVPFKPARVILQDFTGVPAVVDFAAMRDAVKKLGGDPEKINPVCPADLVIDHSIQVDFNRRADSLQKNQDLEFERNRERFEFLKWGSQAFHNMRIIPPGSGIIHQVNLEYLARVVFDQDGYYYPDSLVGTDSHTTMIDGLGILGWGVGGIEAEAVMLGQPISMVLPQVIGYRLMGKPHPLVTSTDIVLTITKHLRQVGVVGKFVEFFGPGVAQLSIADRATIANMCPEYGATAAFFPVDEVSITYLVQTGRDEEKLKYIKKYLQAVGMFRDFNDPSQDPDFTQVVELDLKTVVPCCSGPKRPQDKVAVSDMKKDFESCLGAKQGFKGFQVAPEHHNDHKTFIYDNTEFTLAHGSVVIAAITSCTNTSNPSVMLGAGLLAKKAVDAGLNVMPYIKTSLSPGSGVVTYYLQESGVMPYLSQLGFDVVGYGCMTCIGNSGPLPEPVVEAITQGDLVAVGVLSGNRNFEGRVHPNTRANYLASPPLVIAYAIAGTIRIDFEKEPLGVNAKGQQVFLKDIWPTRDEIQAVERQYVIPGMFKEVYQKIETVNESWNALATPSDKLFFWNSKSTYIKSPPFFENLTLDLQPPKSIVDAYVLLNLGDSVTTDHISPAGNIARNSPAARYLTNRGLTPREFNSYGSRRGNDAVMARGTFANIRLLNRFLNKQAPQTIHLPSGEILDVFDAAERYQQAGLPLIVLAGKEYGAGSSRDWAAKGPFLLGIKAVLAESYERIHRSNLVGMGVIPLEYLPGENADALGLTGQERYTIIIPENLKPQMKVQVKLDTGKTFQAVMRFDTDVELTYFLNGGILNYMIRKMAK

SEQ ID NO: 56 - protein, 238 aa, Artificial Sequence
  Synthetic Construct
MAAAPLLLLLLLVPVPLLPLLAQGPGGALGNRHAVYWNSSNQHLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 57 - protein, 368 aa, Artificial Sequence
  Synthetic Construct
MLSKRGCHARIYADFPIRRLISQRSSLETLEDIEENAPLRRCRTLSGSPRPKNFKKIHFIKNMRQHDTRNGRIVLISGRRSFCSIFSVLPYRDSTQVGDLKLDGGRQSTGAVSLKEIIGLEGVELGADGKTVSYTQFLLPTNAFGARRNTIDSTSSFSQFRNLSHRSLSIGRASGTQGSLDTGSDLGDFMDYDPNLLDDPQWPCGKHKRVLIFPSYMTTVIDYVKPSDLKKDMNETFKEKFPHIKLTLSKIRSLKREMRKLAQEDCGLEEPTVAMAFVYFEKLALKGKLNKQNRKLCAGACVLLAAKIGSDLKKHEVKHLIDKLEEKFRLNRRELIAFEFPVLVALEFALHLPEHEVMPHYRRLVQSS

SEQ ID NO: 58 - protein, 213 aa, Artificial Sequence
  Synthetic Construct
MGNGTEEDYNFVFKVVLIGESGVGKTNLLSRFTRNEFSHDSRTTIGVEFSTRTVMLGTAAVKAQIWDTAGLERYRAITSAYYRGAVGALLVFDLTKHQTYAVVERWLKELYDHAEATIVVMLVGNKSDLSQAREVPTEEARMFAENNGLLFLETSALDSTNVELAFETVLKEIFAKVSKQRQNSIRTNAITLGSAQAGQEPGPGEKRACCISL

SEQ ID NO: 59 - protein, 759 aa, Artificial Sequence
  Synthetic Construct
MADEAPRKGSFSALVGRTNGLTKPAALAAAPAKPGGAGGSKKLVIKNFRDRPRLPDNYTQDTWRKLHEAVRAVQSSTSIRYNLEELYQAVENLCSHKVSPMLYKQLRQACEDHVQAQILPFREDSLDSVLFLKKINTCWQDHCRQMIMIRSIFLFLDRTYVLQNSTLPSIWDMGLELFRTHIISDKMVQSKTIDGILLLIERERSGEAVDRSLLRSLLGMLSDLQVYKDSFELKFLEETNCLYAAEGQRLMQEREVPEYLNHVSKRLEEEGDRVITYLDHSTQKPLIACVEKQLLGEHLTAILQKGLDHLLDENRVPDLAQMYQLFSRVRGGQQALLQHWSEYIKTFGTAIVINPEKDKDMVQDLLDFKDKVDHVIEVCFQKNERFVNLMKESFETFINKRPNKPAELIAKHVDSKLRAGNKEATDEELERTLDKIMILFRFIHGKDVFEAFYKKDLAKRLLVGKSASVDAEKSMLSKLKHECGAAFTSKLEGMFKDMELSKDIMVHFKQHMQNQSDSGPIDLTVNILTMGYWPTYTPMEVHLTPEMIKLQEVFKAFYLGKHSGRKLQWQTTLGHAVLKAEFKEGKKEFQVSLFQTLVLLMFNEGDGFSFEEIKMATGIEDSELRRTLQSLACGKARVLIKSPKGKEVEDGDKFIFNGEFKHKLFRIKINQIQMKETVEEQVSTTERVFQDRQYQIDAAIVRIMKMRKTLGHNLLVSELYNQLKFPVKPGDLKKRIESLIDRDYMERDKDNPNQYHYVA

SEQ ID NO: 60 - protein, 837 aa, Artificial Sequence
  Synthetic Construct
MLRTAMGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGSRVFTESEKRPLSIQDSFVEVSPVCPRPRVRLGSEIRDSVV

SEQ ID NO: 61 - protein, 167 aa, Artificial Sequence
  Synthetic Construct
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 62 - protein, 644 aa, Artificial Sequence
  Synthetic Construct
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMASGEIGPSKPVEK

SEQ ID NO: 63 - protein, 1016 aa, Artificial Sequence
  Synthetic Construct
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKNVLDFYKQWKEIG

SEQ ID NO: 64 - protein, 707 aa, Artificial Sequence
  Synthetic Construct
MSRDRFRSRGGGGGGFHRRGGGGGRGGLHDFRSPPPGMGLNQNRGPMGPGPGQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 65 - protein, 506 aa, Artificial Sequence
  Synthetic Construct
MPSKTKYNLVDDGHDLRIPLHNEDAFQHGICFEAKYVGSLDVPRPNSRVEIVAAMRRIRYEFKAKNIKKKKVSIMVSVDGVKVILKKKKKLLLLQKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 66 - protein, 100 aa, Artificial Sequence
  Synthetic Construct
MRALTLLALLALAALCIAGQAGAKPSGAESSKGAAFVSKQEGSEVVKRPRRYLYQWLGAPVPYPDPLEPRREVCELNPDCDELADHIGFQEAYRRFYGPV

SEQ ID NO: 67 - DNA, 1893 bp, Artificial Sequence
  Synthetic Construct
atgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 68 - DNA, 2667 bp, Artificial Sequence
  Synthetic Construct
atgctgagcctcctcgtctggatcctcactctctccgatactttctcccaagggacccagacccgcttcagccaggagccagctgaccagacggtggtggctggacagcgggccgtgctcccctgtgtgctgctcaactactctggaattgtgcaatggaccaaggacgggctggccctgggcatgggccagggcctcaaagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcatccccccagaggacaccaggattgacggaggccctgtgattctactgcaggcaggcaccccccacaacctcacatgccgggccttcaatgcgaagcctgctgccaccatcatctggttccgggacgggacgcagcaggagggcgctgtggccagcacggaattgctgaaggatgggaagagggagaccaccgtgagccaactgcttattaaccccacggacctggacatagggcgtgtcttcacttgccgaagcatgaacgaagccatccctagtggcaaggagacttccatcgagctggatgtgcaccaccctcctacagtgaccctgtccattgagccacagacggtgcaggagggtgagcgtgttgtctttacctgccaggccacagccaaccccgagatcttgggctacaggtgggccaaagggggtttcttgattgaagacgcccacgagagtcgctatgagacaaatgtggattattcctttttcacggagcctgtgtcttgtgaggttcacaacaaagtgggaagcaccaatgtcagcactttagtaaatgtccactttgctccccggattgtagttgaccccaaacccacaaccacagacattggctctgatgtgacccttacctgtgtctgggttgggaatccccccctcactctcacctggaccaaaaaggactcaaatatggtcctgagtaacagcaaccagctgctgctgaagtcggtgactcaggcagacgctggcacctacacctgccgggccatcgtgcctcgaatcggagtggctgagcgggaggtgccgctctatgtgaacgggccccccatcatctccagtgaggcagtgcagtatgctgtgaggggtgacggtggcaaggtggagtgtttcattgggagcacaccacccccagaccgcatagcatgggcctggaaggagaacttcttggaggtggggaccctggaacgctatacagtggagaggaccaactcaggcagtggggtgctatccacgctcaccatcaacaatgtcatggaggccgactttcagactcactacaactgcaccgcctggaacagcttcgggccaggcacagccatcatccagctggaagagcgagacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 69 - DNA, 2379 bp, Artificial Sequence
  Synthetic Construct
atggacgtgacagtctcggagctcctggagctcttcctgcagagcccgctggtgacctgggtgaaaacttttggcccgtttggaagcggcagccaggacaacctgactatgtacatggatttagtggacggcatctttttgaaccaaattatgctgcaaatagatcccaggcccacaaatcaacgcatcaataagcacgtcaacaatgatgtgaaccttcgcattcagaatttgaccatcttggtgagaaacattaagacctactaccaggaagttctccagcagctgattgtaatgaatttgcccaatgttttgatgattggcagagacccactgtctgggaagagcatggaggaaatcaagaaggtgctgctgctggtgctgggctgtgctgtccagtgtgagaggaaagaggagttcattgaaagaatcaaacagctggacattgagacccaggctggcatcgtggcccatatccaggaggtgactcacaaccaagagaacgtgtttgacctgcagtggctggagctgcccgacgtggctccggaggagctggaggccctgtcgaggagcatggtgctccacctgcggaggctcatcgaccagcgggacgagtgcaccgagctgatcgtggacctcactcaggaacgggactacctgcaggcacagcatccacccagccccatcaagtcctccagcgccgactccactcccagccccaccagcagcctctctagcgaagacaagcagcacctggccgtagagctggccgacaccaaggccaggctgcggcgcgtcaggcaggagctggaggataagacagagcagcttgtggacaccagacatgaggtggaccagctggtgctggaactgcagaaagttaagcaggagaacatccagctagcggcagacgcccggtctgctcgtgcctatcgagacgagctggattccctgcgggagaaggcgaaccgcgtggagaggctggagctggagctgacccgctgcaaggagaagctgcacgacgtggacttctacaaggcccgcatggaggagctgagagaagataatatcattttaattgaaaccaaggccatgctggaggaacagctgactgctgctcgggcccggggcgataaagtccatgagctggaaaaggagaacctgcagctgaaatccaagcttcacgacctggaattggaccgggacacagataagaaacgaattgaggagctgctggaagaaaacatggtccttgagattgcacagaagcagagcatgaacgaatctgcccaccttggctgggagctggagcagctgtccaagaacgcagacttgtcagacggcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 70 - DNA, 4233 bp, Artificial Sequence
  Synthetic Construct
atggcacagagcaagaggcacgtgtacagccggacgcccagcggcagcaggatgagtgcggaggcaagcgcccggcctctgcgggtgggctcccgtgtagaggtgattggaaaaggccaccgaggcactgtggcctatgttggagccacactgtttgccactggcaaatgggtaggcgtgattctggatgaagcaaagggcaaaaatgatggaactgttcaaggcaggaagtacttcacttgtgatgaagggcatggcatctttgtgcgccagtcccagatccaggtatttgaagatggagcagatactacttccccagagacacctgattcttctgcttcaaaagtcctcaaaagagagggaactgatacaactgcaaagactagcaaactgcggggactgaagcctaagaaggcaccgacagcccgaaagaccacaactcggcgacccaagcccacgcgcccagccagtactggggtggctggggccagtagctccctgggcccctctggctcagcgtcagcaggtgagctgagcagcagtgagcccagcaccccggctcagactccgctggcagcacccatcatccccacgccggtcctcacctctcctggagcagtccccccgcttccttccccatccaaggaggaggagggactaagggctcaggtgcgggacctggaggagaaactagagaccctgagactgaaacgggcagaagacaaagcaaagctaaaagagctggagaaacacaaaatccagctggagcaggtgcaggaatggaagagcaaaatgcaggagcagcaggccgacctgcagcggcgcctcaaggaggcgagaaaggaagccaaggaggcgctggaggcaaaggaacgctatatggaggagatggctgatactgctgatgccattgagatggccactttggacaaggagatggctgaagagcgggctgagtccctgcagcaggaggtggaggcactgaaggagcgggtggacgagctcactactgacttagagatcctcaaggctgagattgaagagaagggctcagatggcgctgcatccagttatcagctcaagcagcttgaggagcagaatgcccgcctgaaggatgccctggtgaggatgcgggatctttcttcctcagagaagcaggagcatgtgaagctccagaagctcatggaaaagaagaaccaagagctggaagttgtgaggcaacagcgggagcgtctgcaggaggagctaagccaggcagagagcaccattgatgagctcaaggagcaggtggatgctgctctgggtgctgaggagatggtggagatgctgacagatcggaacctgaatctggaagagaaagtgcgcgagttgagggagactgtgggagacttggaagcgatgaatgagatgaacgatgagctgcaggagaatgcacgtgagacagaactggagctgcgggagcagctggacatggcaggcgcgcgggttcgtgaggcccagaagcgtgtggaggcagcccaggagacggttgcagactaccagcagaccatcaagaagtaccgccagctgaccgcccatctacaggatgtgaatcgggaactgacaaaccagcaggaagcatctgtggagaggcaacagcagccacctccagagacctttgacttcaaaatcaagtttgctgagactaaggcccatgccaaggcaattgagatggaattgaggcagatggaggtggcccaggccaatcgacacatgtccctgctgacagccttcatgcctgacagcttccttcggccaggtggggaccatgactgcgttctggtgctgttgctcatgcctcgtctcatttgcaaggcagagctgatccggaagcaggcccaggagaagtttgaactaagtgagaactgttcagagcggcctgggctgcgaggagctgctggggagcaactcagctttgctgctggactggtgtactcgctgagcctgctgcaggccacgctacaccgctatgagcatgccctctctcagtgcagtgtggatgtgtataagaaagtgggcagcctgtaccctgagatgagtgcccatgagcgctccttggatttcctcattgaactgctgcacaaggatcagctggatgagactgtcaatgtggagcctctcaccaaggccatcaagtactatcagcatctgtacagcatccaccttgccgaacagcctgaggactgtactatgcagctggctgaccacattaagttcacgcagagtgctctggactgcatgagtgtggaggtaggacggctgcgtgccttcttgcagggtgggcaggaggctacagatattgccctcctgctccgggatctggaaacttcatgcagtgacatccgccagttctgcaagaagatccgaaggcgaatgccagggacagatgctcctgggatcccagctgcactggcctttggaccacaggtatctgacacgctcctagactgcaggaaacacttgacgtgggtcgtggctgtgctgcaggaggtggcagctgctgctgcccagctcattgccccactggcagagaatgaggggctacttgtggctgctctggaggaactggctttcaaagcaagcgagcagatctatgggaccccctccagcagcccctatgagtgtctgcgccagtcatgcaacatcctcatcagtaccatgaacaagctggccacagccatgcaggagggggagtatgatgcagagcggccccccagcaagcctccaccggttgaactgcgggctgctgcccttcgtgcagagatcacagatgctgaaggcctgggtttgaagctcgaagatcgagagacagttattaaggagttgaagaagtcactcaagattaagggagaggagctaagtgaggccaatgtgcggctgagcctcctggagaagaagttggacagtgctgccaaggatgcagatgagcgcatcgagaaagtccagactcggctggaggagacccaggcactgctgcgaaagaaggagaaagagtttgaggagacaatggatgcactccaggctgacatcgaccagctggaggcagagaaggcagaactaaagcagcgtctgaacagccagtccaaacgcacgattgagggactccggggccctcctccttcaggcattgctactctggtctctggcattgctggtggcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 71 - DNA, 3093 bp, Artificial Sequence
  Synthetic Construct
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtattattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaataggcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 72 - DNA, 1806 bp, Artificial Sequence
  Synthetic Construct
atggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttaggcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 73 - DNA, 1614 bp, Artificial Sequence
  Synthetic Construct
atgaccatgtatttgtggcttaaactcttggcatttggctttgcctttctggacacagaagtatttgtgacagtcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 74 - DNA, 1797 bp, Artificial Sequence
  Synthetic Construct
atgggccggtctcggagccggagctcgtcccgctccaagcacaccaagagcagcaagcacaacaagaagcgcagccggtcccggtcgcgatcccgggacaaggagcgcgtgcggaagcgttccaaatctcgggaaagtaaacggaaccggcggcgggagtcgcggtcccgttcgcgctccaccaacacggccgtgtcccggcgcgagcgggaccgggagcgcgcctcgtccccgcccgaccgcatcgacatcttcgggcgcacggtgagcaagcgcagcagcctggacgagaagcagaagcgagaggaggaggagaagaaagcggagttcgagcggcagcgaaaaattcgacagcaagaaatagaagaaaaactcatcgaggaagaaacagcacgaagagtagaagaattggtagcaaaaagggtggaggaagaactggagaaaaggaaggatgaaattgaacgagaagttctccgaagggtggaggaagccaaacgcatcatggaaaagcagttgctcgaagaactcgagcgacagagacaagctgagcttgccgcacaaaaagctagagaggaggaagaacgtgcaaaacgtgaggagctagagcgaatactggaagagaataaccgaaaaattgcagaagcacaagccaaactggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 75 - DNA, 1668 bp, Artificial Sequence; identical to SEQ ID NO: 5
  Synthetic Construct

SEQ ID NO: 76 - DNA, 1611 bp, Artificial Sequence
  Synthetic Construct
atgcgggtccggatagggctgacgctgctgctgtgtgcggtgctgctgagcttggcctcggcgtcctcggtcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 77 - DNA, 2472 bp, Artificial Sequence
  Synthetic Construct
atgcacagagcgccttcccccacagccgagcagccgccgggcggaggggacagcgcccgccggaccctgcagcccagactcaagcccagtgcccgagccatggcactgcctcggacgctgggggagctgcagctgtaccgggtcctgcagcgcgccaacctcctttcctactatgagaccttcatccagcagggaggggacgacgtgcagcagctgtgtgaggcgggtgaggaggagtttctggagatcatggcacttgtgggcatggccaccaagcccctccatgtccggcgcctgcagaaggcactgagagagtgggccaccaatccagggctcttcagtcaaccagtgcctgctgttcccgtctccagcatcccgctcttcaagatctctgagactgcgggtacccggaaagggagcatgagcaatgggcatggcagcccaggggaaaaggcaggcagtgcccgcagttttagccccaagagcccccttgaacttggagagaagctatcaccactgcctgggggacctggggcaggggacccccggatctggccaggccggagcactccagagtcggacgttggggcaggaggagaagaggaggctggctcgccccccttctccccccctgcagggggaggagtccctgaggggactggggctggggggctggcagcaggtgggactgggggtggtccagaccgactggagccagagatggtacgcatggtggtggaaagtgtggagaggatcttccggagcttcccaaggggggatgctggggaggtcacatccctgctaaagctgaataagaagctggcacggagcgttgggcacatctttgagatggatgataatgacagccagaaggaagaggagatccgcaaatacagcatcatctatggccgtttcgactctaagcggcgggagggcaagcagctcagcctgcacgagctcaccatcaacgaggctgctgcccagttctgcatgagggacaacacgctcttattacggagagtggagctcttctctttgtcccgccaagtagcccgagagagcacctacttgtcctccttgaagggctccaggcttcaccctgaagaactgggaggccctccactgaagaagctgaaacaagaggttggagaacagagtcaccctgaaatccagcagcctcccccaggccctgagtcctatgtacccccataccgccccagcctggaggaggacagcgccagcctgtctggggagagtctggatggacatttgcaggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 78 - DNA, 1992 bp, Artificial Sequence
  Synthetic Construct
atgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtga

SEQ ID NO: 79 - DNA, 2676 bp, Artificial Sequence
  Synthetic Construct
atgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctcctgtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactggtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatag

SEQ ID NO: 80 - DNA, 1308 bp, Artificial Sequence
  Synthetic Construct
atgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgtctttctcctacatggacagctataaccatgacattcgttttgacaacatctacatcagtacctacttctgccagatcgatgaccgcaggaagaagctgggcaaacggactctgctgccactccgcaaagctgaggagaaaaccgtcatcttcccttgcaagcccaccatccaggcctcagaaatgagcaatgtggtgagggagctcctggagacactgcccattctgctgctgctggtggtgctgtgtggcttggactgggctctctactccatcttcgacaccatccgccaccactccttcctgcagtactccttccgcagcagtcataaactggaggtgaaggtcgggggagactccatgctagcccggcttcttcgaaaaaccattggggccctgaacacctcctcagagacagtgatggaatcaaacaacatgccctgcctgccccagcctgtgggcctggatgccagggcctactggagagctgcagtaccgattggcctgttagtgtgtctctgcctgttacaggcttttggctaccgactccggagggtcatcgcagccttctacttccccaagcgagagaagaagcggatcctgttcctctacaatgacctattgaagaaaagagcagccttcaccaaactcaggagggccgctatcctgaggcgggagcgacagcagaaggctccgcgccacccgctggcggatatcctgcaccgcggctgcccgctcctgcgccgctggctgtgccggcgctgcgtggtgtgccaggcacccgagacgcccgagtcctacgtgtgccggacgctggactgcgaggccgtgtactgctggtcgtgctgggacgacatgcggcagcggtgcccggtctgcacgccccgcgaagagctctcttcctccgcctttagtgacagcaacgacgacactgcctacgcggggtga

SEQ ID NO: 81 - protein, 630 aa, Artificial Sequence
  Synthetic Construct
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 82 - protein, 888 aa, Artificial Sequence
  Synthetic Construct
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEERDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 83 - protein, 792 aa, Artificial Sequence
  Synthetic Construct
MDVTVSELLELFLQSPLVTWVKTFGPFGSGSQDNLTMYMDLVDGIFLNQIMLQIDPRPTNQRINKHVNNDVNLRIQNLTILVRNIKTYYQEVLQQLIVMNLPNVLMIGRDPLSGKSMEEIKKVLLLVLGCAVQCERKEEFIERIKQLDIETQAGIVAHIQEVTHNQENVFDLQWLELPDVAPEELEALSRSMVLHLRRLIDQRDECTELIVDLTQERDYLQAQHPPSPIKSSSADSTPSPTSSLSSEDKQHLAVELADTKARLRRVRQELEDKTEQLVDTRHEVDQLVLELQKVKQENIQLAADARSARAYRDELDSLREKANRVERLELELTRCKEKLHDVDFYKARMEELREDNIILIETKAMLEEQLTAARARGDKVHELEKENLQLKSKLHDLELDRDTDKKRIEELLEENMVLEIAQKQSMNESAHLGWELEQLSKNADLSDGPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 84 - protein, 1410 aa, Artificial Sequence
  Synthetic Construct
MAQSKRHVYSRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGGPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 85 - protein, 1030 aa, Artificial Sequence
  Synthetic Construct
MDGFAGSLDDSISAASTSDVQDRLSALESRVQQQEDEITVLKAALADVLRRLAISEDHVASVKKSVSSKGQPSPRAVIPMSCITNGSGANRKPSHTSAVSIAGKETLSSAAKSGTEKKKEKPQGQREKKEESHSNDQSPQIRASPSPQPSSQPLQIHRQTPESKNATPTKSIKRPSPAEKSHNSWENSDDSRNKLSKIPSTPKLIPKVTKTADKHKDVIINQEGEYIKMFMRGRPITMFIPSDVDNYDDIRTELPPEKLKLEWAYGYRGKDCRANVYLLPTGKIVYFIASVVVLFNYEERTQRHYLGHTDCVKCLAIHPDKIRIATGQIAGVDKDGRPLQPHVRVWDSVTLSTLQIIGLGTFERGVGCLDFSKADSGVHLCIIDDSNEHMLTVWDWQKKAKGAEIKTTNEVVLAVEFHPTDANTIITCGKSHIFFWTWSGNSLTRKQGIFGKYEKPKFVQCLAFLGNGDVLTGDSGGVMLIWSKTTVEPTPGKGPKGVYQISKQIKAHDGSVFTLCQMRNGMLLTGGGKDRKIILWDHDLNPEREIEVPDQYGTIRAVAEGKADQFLVGTSRNFILRGTFNDGFQIEVQGHTDELWGLATHPFKDLLLTCAQDRQVCLWNSMEHRLEWTRLVDEPGHCADFHPSGTVVAIGTHSGRWFVLDAETRDLVSIHTDGNEQLSVMRYSIGPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 86 - protein, 601 aa, Artificial Sequence
  Synthetic Construct
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILGPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 87 - protein, 537 aa, Artificial Sequence
  Synthetic Construct
MTMYLWLKLLAFGFAFLDTEVFVTVPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 88 - protein, 598 aa, Artificial Sequence
  Synthetic Construct
MGRSRSRSSSRSKHTKSSKHNKKRSRSRSRSRDKERVRKRSKSRESKRNRRRESRSRSRSTNTAVSRRERDRERASSPPDRIDIFGRTVSKRSSLDEKQKREEEEKKAEFERQRKIRQQEIEEKLIEEETARRVEELVAKRVEEELEKRKDEIEREVLRRVEEAKRIMEKQLLEELERQRQAELAAQKAREEEERAKREELERILEENNRKIAEAQAKLVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 89 - protein, 555 aa, Artificial Sequence
  Synthetic Construct
MPSLVVSGIMERNGGFGELGCFGGSAKDRGLLEDERALQLALDQLCLLGLGEPPAPTAGEDGGGGGGGAPAQPAAPPQPAPPPPPAAPPAAPTAAPAAQTPQPPTAPKGASDAKLCALYKEAELRLKGSSNTTECVPVPTSEHVAEIVGRQVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 90 - protein, 536 aa, Artificial Sequence
  Synthetic Construct
MRVRIGLTLLLCAVLLSLASASSVPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 91 - protein, 823 aa, Artificial Sequence
  Synthetic Construct
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 92 - protein, 663 aa, Artificial Sequence
  Synthetic Construct
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRGLSSFKQNHENLCDNSLQLQECREVGGGASAASSLLPQPIPTTPDIENAELTPILPFLFLGNEQDAQDLDTMQRLNIGYVINVTTHLPLYHYEKGLFNYKRLPATDSNKQNLRQYFEEAFEFIEEAHQCGKGLLIHCQAGVSRSATIVIAYLMKHTRMTMTDAYKFVKGKRPIISPNLNFMGQLLEFEEDLNNGVTPRILTPKLMGVETVV

SEQ ID NO: 93 - protein, 891 aa, Artificial Sequence
  Synthetic Construct
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSCFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 94 - protein, 435 aa, Artificial Sequence
  Synthetic Construct
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLSFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPRHPLADILHRGCPLLRRWLCRRCVVCQAPETPESYVCRTLDCEAVYCWSCWDDMRQRCPVCTPREELSSSAFSDSNDDTAYAG

SEQ ID NO: 95 - DNA, 2382 bp, Artificial Sequence
  Synthetic Construct
atgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatga

SEQ ID NO: 96 - DNA, 4937 bp, Artificial Sequence
  Synthetic Construct
gggcgcttcgctgatggtgtcggtgagcgcgtttcccgcctgagcgcaactagcggcgggtcgtgggcacctccagataagaaaacaagctcagagagatgtggtgacttgctcaaatagtgacagaacttcctcggccatatggaggggtcatataatacccttgtgtcttcagtttgaggagagcttgtttcatatccatatcccactgtattcctgctaatctgctaatgcagtaaattggaggaaaactgttaccaggataacctgtaatgggcaaggagccacaaagaagaaaacatttcttttaatttttaaacttggtttgaaagaccagcatgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacaggctgagggaggaagacggcatggttacatgggacacctaacgaggatagctaactgtatcgtgcacagcactgacaagggccccaacagtgcattagtgcagcagcttatcaaagatcttcccgacgaagtcagggaacgatgggagacgttctgcacaagctccttaggagaaactaacaagaggaacacggtagatctagccttttctgattatcagatgcaacaaatgacgtccaattttattgaccagtttggcttcaacgatgagaagtttgcagatcaagatgacattggcaatgtttcttttgatcgagtatcagacatcaactttactctcaatacaaatgaaagtggaaatattgccttgtttgaagcatgttgtaaggaaagaatacaacagtttgatgatggtggctctgatgaggaagatatatgggaggaaaagcacatcgcattcacaccagaatcccaaagacgatccagctcggggagtacagacagtgaggaaagtacagactctgaagaagaagatggagcaaagcaagacttgtttgaacccagcagtgccaacacggaggataaaatggaggtggacctgagtgaaccacccaactggtcagctaactttgatgtcccaatggaaacaacccacggtgctccattggattctgtgggatctgatgtctggagcacagaggagccgatgccaactaaagagacgggctgggcttctttttcagagttcacgtcttccctgagcacaaaagattctttaaggagtaattctccagtggaaatggaaaccagcactgaacccatggaccctctgactcccagtgcggctgccctggcagtgcagccagaagcggcaggcagtgtggccatggaagccagctctgacggagaggaggatgcagaaagtacagacaaggtaactgagacagtgatgaatggcggcatgaaggaaacgctcagcctcactgtagatgccaagacagagactgcggtcttcaaaagtgaggaagggaaactgtctacctctcaagatgctgcttgtaaagacgcagaggagtgtcccgagactgcagaggcgaagtgcgcggcgcccaggcctcccagcagcagtcccgagcagaggactggccaaccaagcgcaccaggtgacacttcagtgaatggccctgtatgacgggtgacgtctgctgctgctgactgaggactgcagaccgccaccactcaggggctctggaggggtcagctggagcccaccaagctgtcactgctgcactcactctgcaagggatcaggaccagcaacctttatattctagattctaagacattgtacagagaaattcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctaaacattacattgcatatggaaataaaagaatcaaacgtctaatgccttattatttctgatttcctttttcattttaagtggtgtggagattccagcactcccaggacagtggagtcagcagtaagccctgggacaggtggcaagggtgggtcccttgacctttgcacgcctcctcaggaaccccctttcccgggtgagcccctctctgaagagactgtccttgggcctcctctggaagcagcacccccagaggacagggctcctcctgcttgcctcagggctgcctgacttgaatggcgttggacctcggggattactggtagataatatgctctggtctcgcctggtggtgagttttgccagccatggccagggtttggctccactggtggcacacgtggcctccgtggtatggacctggtggcttctccatcccactgtggcctctgtggtatggacctggtggcttctccatcctacccaaggtaacagtgtcttgcttcatcccactgactgctgggagagagcctctgggacttttctttggggcatcattttgttttgtctttcgtagcagggaaaggatatgacaatggggaggacagttcttttggaggttggaggggccaagccaaggacaggagcaagtgtgccctcattttgtttctacttttaatttctgtgtgttggccatactgaattatgagactaacagatgtctacaatacaatacctgtattcaaaataacaaaaataaagcctgattctttgtttctagaaa

SEQ ID NO: 97 - DNA, 1299 bp, Artificial Sequence
  Synthetic Construct
atgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgccgcacaccaccaccatcaccaccacccaccccagccgccgccgccgccgcccccgccgccgccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtccgtcatgcaccacctgggctaccccgtgcccggccagcttggcaacgtcgtcagctccgtgtggccgcacgttggcgtcatggattcggtggccgccgccgcggccgccgcagccgcagccggagtccctgtaggcccggagtatggggccttcggggtcccggtcaagtccctgtgccactcggcaagccagagcctgcctgccatgccggtgcccatcaagcccacgcctgcgctgccgcccgtgtccgcgctgcagccggggctcactgtccccgcggcttcgcagcagcctccggcgccatccaccgtgtgctccgcggccgcggcctcgcccgttgcctctctgctggagcccacagcccctacctcggccgaaagcaagggcggctccttgcactcggtgctagtgcactcctag

SEQ ID NO: 98 - DNA, 2862 bp, Artificial Sequence
  Synthetic Construct
atggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctga

SEQ ID NO: 99 - DNA, 4503 bp, Artificial Sequence
  Synthetic Construct
agttcccgttccgggcccgcgaggcagccgccccggtcctgcccctccctcgcgctactgcgggagcagcgtcctcccgggccacggcgcttcccggccccggcgtccccggaccatggcgctctccgggctcttctctagctctcagcggctgcgaagtctgtaaacctggtggccaagtgattgtaagtcaggagactttccttcggtttctgcctttgatggcaagaggtggagattgtggcggcgattacagaaaacatctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactctta

SEQ ID NO: 100 - DNA, 3030 bp, Artificial Sequence
  Synthetic Construct
atgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtga

SEQ ID NO: 101 - DNA, 5041 bp, Artificial Sequence
  Synthetic Construct
cgcgcgccgggcacgcgcgccggcgaccatggcgttcgccgggctggagcgagtacattaacccctggaggcggcggcggcggcgagggagcgagcctcgagcgggcgggccccagcctgagggaagggaggaaggggcggggagagcgccagagggaggccggtcggccgcgggcgggcgggcagcgcagcgccgagcggggcccgcgggcccatgaggaggcctggggaccatgggctccaggatcaagcagaatccagagaccacatttgaagtatatgttgaagtggcctatcccaggacaggtggcactctttcagatcctgaggtgcagaggcaattcccggaggactacagtgaccaggaagttctacagactttgaccaagttttgtttccccttctatgtggacagcctcacagttagccaagttggccagaacttcacattcgtgctcactgacattgacagcaaacagagattcgggttctgccgcttatcttcaggagcgaagagctgcttctgtatcttaagctatctcccctggttcgaggtattttataagctgcttaacatcctggcagattacacgacaaaaagacaggaaaatcagtggaatgagcttcttgaaactctgcacaaacttcccatccctgacccaggagtgtctgtccatctcagcgtgcattcttattttactgtgcctgataccagagaacttcccagcatacctgagaatagaaatctgacagaatattttgtggctgtggatgttaacaacatgttgcatctgtacgccagtatgctgtacgaacgccggatactcatcatttgcagcaaactcagcactctgactgcctgcatccacgggtctgcggcgatgctctaccccatgtactggcagcacgtgtacatccccgtgctgccgccgcatctgctggactactgctgtgctcccatgccctacctcataggaatccatttaagtttaatggagaaagtcagaaacatggccctggatgatgtcgtgatcctgaatgtggacaccaacaccctggaaacccccttcgatgacctccagagcctcccaaacgacgtgatctcttccctgaagaacaggctgaaaaaggtctccacaaccactggggatggtgtggccagagcgttcctcaaggcccaggctgctttcttcggtagctaccgaaacgctctgaaaatcgagccggaggagccgatcactttctgtgaggaagccttcgtgtcccactaccgctccggagccatgaggcagttcctgcagaacgccacacagctgcagctcttcaagcagtttattgatggtcgattagatcttctcaattccggcgaaggtttcagtgatgtttttgaagaggaaatcaacatgggcgagtacgctggcagtgacaaactgtaccatcagtggctctccactgtccggaaaggaagtggagcaattctgaatactgtaaagaccaaagcaaatccggccatgaagactgtctacaagttcgcaaaagatcatgcaaaaatgggaataaaagaggtgaaaaaccgcttgaagcaaaaggacattgccgagaatggctgcgcccccaccccagaagagcagctgccaaagactgcaccgtccccactggtggaggccaaggaccccaagctccgagaagaccggcggccaatcacagtccactttggacaggtgcgcccacctcgtccacatgttgttaagagaccaaagagcaacatcgcagtggaaggccggaggacgtctgtgccgagccctgagcagccgcagccgtatcggacactcagggagtcagacagcgcggaaggcgacgaggcagagagtccagagcagcaagtgcggaagtccacaggccctgtcccagctccccctgaccgggctgccagcatcgaccttctggaagacgtcttcagcaacctggacatggaggccgcactgcagccactgggccaggccaagagcttagaggaccttcgtgcccccaaagacctgagggagcagccagggacctttgactatcagaggctggatctgggcgggagtgagaggagccgcggggtgacagtggccttgaagcttacccacccgtacaacaagctctggagcctgggccaggacgacatggccatccccagcaagcccccagctgcctcccctgagaagccctcggccctgctcgggaactccctggccctgcctcgaaggccccagaaccgggacagcatcctgaaccccagtgacaaggaggaggtgcccacccctactctgggcagcatcaccatcccccggccccaaggcaggaagaccccagagctgggcatcgtgcctccaccgcccattccccgcccggccaagctccaggctgccggcgccgcacttggtgacgtctcagagcggctgcagacggatcgggacaggcgagctgccctgagtccagggctcctgcctggtgttgtcccccaaggccccactgaactgctccagccgctcagccctggccccggggctgcaggcacgagcagtgacgccctgctcgccctcctggacccgctcagcacagcctggtcaggcagcaccctcccgtcacgccccgccaccccgaatgtagccaccccattcaccccccaattcagcttcccccctgcagggacacccaccccattcccacagccaccactcaacccctttgtcccatccatgccagcagccccacccaccctgcccctggtctccacaccagccgggcctttcggggcccctccagcttccctggggccggcttttgcgtccggcctcctgctgtccagtgctggcttctgtgcccctcacaggtctcagcccaacctctccgccctctccatgcccaacctctttggccagatgcccatgggcacccacacgagccccctacagccgctgggtcccccagcagttgccccgtcgaggatccgaacgttgcccctggcccgctcaagtgccagggctgctgagaccaagcaggggctggccctgaggcctggagaccccccgcttctgcctcccaggccccctcaaggcctggagccaacactgcagccctctgctcctcaacaggccagagacccctttgaggatttgttacagaaaaccaagcaagacgtgagcccgagtccggccctggccccggccccagactcggtggagcagctcaggaagcagtgggagaccttcgagtgagccgggccctgagggtgggggatgcaccgaggcccgagggtccgtccactgctgcggttccgaggctcccccgccactctctctctgcccaggttctgctggtgggaagggatgggacccctctctgctgccccctcctcccctccacactgcccatctctgatgtctggccctggggaatggcaccagttccagcctgggaatcaacccagttcctgagtgcccatcccaccccgcggttgcctctcctcggcacccttgattgggttttgcactaaagaggtcagctgggccaatgatattgctccagaccgagtcctacccaccttcccccggaagtgtcccaagaggctccgaaggcctcccctccgagcccagctctcctgtctcctccacagccaggccctgcacgcccacctcctcggacacaggtgacagggttaccctccagtttgagctcatctgcacgagacacaggtagcttggggttgaagttaggactcctcctgggctggaggatttacctggtggggcacttccagactgtttctagcaatatacacacacgttctttcctgtgtcttcaccccaaaacttcagttgattctgacctgggaggatctggggaccagggggtcttgggctgccttgtgatacacagccccagccaccctgcacgggggctgcgagcaccagcaactttgatttatagaaggaaaatggaaacccccatctgagtattttgggaggagcccccagccctcatccagctctggcacgctgatacctccaggtactcccctcactgtcaaagctggggctcagcctcttgtcatctggagctttgtgggcaaagctgagaagctgcaacccagatttcaacccaaaaaggtcaagctgaatgcctcagactgatgtggaaggcagctggccttcctgggttggaacgaggcagtggccctgagccccttctccagggccaggtagaaaggacaaacttggtctctgcctcggggaagcaggaggagggctagaagccagtccctccccacctgcccagagctccaggccagcacagaaattcctgaggccaacgtcaccaaagttagattgaatgtttattatctttctttttcctttttaccttattgatttgatgaatcttgaaatggattcatttccataaaccaagttaaagtatggcccgaccatttaagaaaacaaccatctgagacacgcaggaaattgtgagcatttcgacccgagctctcatttcctatttgtgaagggtcagacacagtctacccaggggtgtctgggggacaagggggtctctggagatgtcacccagggagccccctctatgtctgagaggctgccactgctgcacatgctcagtgaggcttggcggccatcctggcacatggctcttcctgggtcaaccgtgacctgtctggctcaggaatgggctctggctgctgggggagccgtgtcactcctgggccatgggggcacctcctgggcacttaggtgtttcagcatagattccagtttcgcaccctgggcagacccccaggccccatccgggatagggcagaggaggtgctggcggccccagggaaggagggtgtgtaccccaaggccccctggctgtgctgaggggctggggtgagcgctccatgttcacatgagcactgctgcctcttcacttgtgggactttttgcaaacccaaggatgaactttgtgtgcattcaataaaatcatcttggggaagagg

SEQ ID NO: 102 - DNA, 738 bp, Artificial Sequence
  Synthetic Construct
atgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcgccatggctacttattctgccacatgtgccaacaatagccctgcacagggcatcaacatggccaacagcattgccaacctgagactgaaggccaaggaatatagtttacagaggaaccaggtgccaacagtcaactga

SEQ ID NO: 103 - DNA, 1770 bp, Artificial Sequence
  Synthetic Construct
atgtcccagcgggtgaggcgcaatgggtcccccacgccggccggctcccttgggggtggtgcggtggccacggccgggggacccgggagccgcttgcagcccatgagggcgacggttccgttccagctgaagcagcagcagcagcagcaacatggcagccccacgcggagcggcggcggcggcggcggcaacaacaacggtggctgctgtggtggcgcctcaggccccgcaggcggcggcggcggcggtggcccgcgcaccgcctcgcgcagcaccagccccacgcgcggcggcgggaacgcggccgcgcgcaccagccccacggtggccacgcagacgggcgcgtccgcgacgtccacgcgaggcaccagccccacgcgcagcgccgcgcctggagctcgcgggagccccccacggccgccgccgccgccgccgctgctgggcaccgtgtcgtcgcccagctcgtcgcccacccacctgtggaccggcgaggtgagcgcggccccacccccagcccgcgtccggcatcggaggaggtctccggagcagagccgaagctcgccggagaagaggagccccagcgccccggtttgcaaagcaggtgacaaaacacgacagccttcttcaagcccctccagtattatccgacgcacttcctccctggatactcttgctgcaccgtatcttgctggacactggcctcgggatagccatgggcaagctgcaccttgcatgagggacaaagctacacagacagagagtgcatgggctgaagaatactctgaaaagaagaaagggtctcacaagcgctcagcatcttggggcagtacagatcaacttaaggagattgcaaaattacgccagcagttgcagagaagtaaacacagcagtcggcatcatcgagataaagaaagacagtctccatttcatggcaaccatgcagctattaaccagtgtcaggctcctgttccaaagagtgcacttattcctgtaattcccatcaccaaatcaacaggctcccggttccggaatagcgtggaaggattgaatcaggagattgaaataataattaaagagactggggaaaaggaagagcaacttataccgcaagatattccagatggccatcgtgctccacccccccttgtacagagaagtagcagcacgcgcagcattgacacacagacgcctggtggggcagacaggggaagcaacaacagcagccgttcccagtccgtgtccccaacatcgttcctcaccatttccaatgaaggtagcgaggagagtccttgctcagcggatgacctgcttgttgatcccagagataaagagaatgggaacaattctcctttgcccaaatatgcaacctcaccaaaacctaacaacagttatatgttcaaaagggaacctcctgagggctgtgaaagggtcaaagtctttgaggaatgctcgccaaaacagcttcatgaaatcccagccttttattgtcctgacaaaaacaaggtgaatttcattcctaaaagtggatctgctttctgcctcgtcagcatcctcaagccactccttcctaccccggatcttacactcaagggctctggccacagcctgacagtcaccactggcatgacaaccactctgctgcagcctattgctgtggcctccctgtctacaaacacagagcaagaccgagtctctcgaggaacaagtacagtcatgccatcagcttctctactcccaccaccagaaccaattgaggaagctgaaggatag

SEQ ID NO: 104 - DNA, 1440 bp, Artificial Sequence
  Synthetic Construct
atgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaa

SEQ ID NO: 105 - DNA, 816 bp, Artificial Sequence
  Synthetic Construct
atggaacacggctccatcatcacccaggcgcggagggaagacgccctggtgctcaccaagcaaggcctggtctccaagtcctctcctaagaagcctcgtggacgtaacatcttcaaggcccttttctgctgttttcgcgcccagcatgttggccagtcaagttcctccactgagctcgctgcgtataaggaggaagcaaacaccattgctaagtcggatctgctccagtgtctccagtaccagttctaccagatcccagggacctgcctgctcccagaggtgacagaggaagatcaaggaaggatctgtgtggtcattgacctcgatgaaacccttgtgcatagctcctttaagccaatcaacaatgctgacttcatagtgcctatagagattgaggggaccactcaccaggtgtatgtgctcaagaggccttatgtggatgagttcctgagacgcatgggggaactctttgaatgtgttctcttcactgccagcctggccaagtatgccgaccctgtgacagacctgctggaccggtgtggggtgttccgggcccgcctattccgtgagtcttgcgtgttccaccagggctgctacgtcaaggacctcagccgcctggggagggacctgagaaagaccctcatcctggacaactcgcctgcttcttacatattccaccccgagaatgcagtgcctgtgcagtcctggtttgatgacatggcagacactgagttgctgaacctgatcccaatctttgaggagctgagcggagcagaggacgtctacaccagccttgggcagctgcgggccccttag

SEQ ID NO: 106 - DNA, 5583 bp, Artificial Sequence
  Synthetic Construct
atgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatggagaatatgttgatgagcatggccactgccagacctgtgaggcctcatgtgccaagtgccagggaccaacccaggaagactgcactacctgccccatgacaaggatttttgatgatggccgctgtgtttcgaactgcccctcatggaaatttgaatttgagaaccaatgccatccatgccaccacacctgccagagatgccaaggaagtggccctacccactgcacctcctgtggagcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtgaagtccaagacccagactatgaagaatgtgtcccttgtgaagaaggatgtctgggatgcagcttggatgatccaggaacatgtacatcttgcgctatggggtattacaggtttgatcaccattgttataaaacctgtcctgagaagacctacagtgaggaagtggaatgcaaggcgtgtgatagtaactgtggcagctgtgaccagaatgggtgttactggtgtgaagagggcttctttctcttaggtggcagttgtgtgaggaaatgtggtcctggattctatggtgaccaagaaatgggagaatgtgagtcctgccaccgagcatgcgaaacctgcacaggccctggtcatgacgagtgcagcagctgccaggaaggactgcagctgctgcgtgggatgtgcgtgcatgccaccaagacccaggaggagggcaaattctggaatgatattttgagaaaactccagccttgtcattcttcttgtaaaacctgcaatggatctgcaactctgtgcacttcatgtcccaaaggtgcatatcttctggctcaggcctgtgtttcctcctgtccccaaggcacatggccttccgtaaggagtgggagctgcgagaactgtacggaggcctgtgccatctgctctggagccgatctttgcaaaaaatgccagatgcagccgggccaccctctcttcctccatgaaggcaggtgctactccaagtgcccggagggctcttatgcagaagacggcatatgtgaacgctgtagctctccttgcagaacatgtgaaggaaacgccaccaactgccattcttgtgaaggaggccacgtcctgcaccacggagtgtgccaggaaaactgccccgagaggcacgtggctgtgaagggggtatgcaagcattgcccagagatgtgtcaggactgcatccatgagaaaacatgcaaagagtgcacgcctgagttcttcctgcacgatgatatgtgccaccagtcctgtccccgtggcttctatgcagactcgcgccactgtgtcccctgccataaagactgtctggagtgcagtggccccaaagccgacgactgcgagctctgtcttgagagttcctgggtcctctatgatggactgtgcttggaggagtgtccagcaggaacctattatgaaaaggagactaaggagtgcagagattgccacaagtcctgcttgacctgctcatcatctgggacctgcaccacctgtcagaaaggcctgatcatgaaccctcgtgggagctgcatggccaacgagaagtgctcaccctccgagtactgggatgaggatgctcccgggtgcaagccctgccatgttaagtgcttccactgcatggggccggcggaggaccagtgtcaaacatgccccatgaacagccttcttctcaacacaacctgtgtgaaggactgcccagagggctattatgccgatgaggacagcaaccggtgtgcccactgccacagctcttgcaggacatgtgaagggagacacagcaggcagtgccactcctgccgaccgggctggttccagctaggaaaagagtgcctgctccagtgcagggaaggatattacgcagacaactccactggccggtgtgagaggtgcaacaggagctgcaaggggtgccagggcccacggcccacagactgcctgtcttgcgatagatttttctttctgctccgctccaaaggagagtgtcatcgctcctgcccagaccattactatgtagagcaaagcacacagacctgtgagagatgccatccgacttgtgatcaatgcaaaggaaaaggagcgttgaattgtttatcctgtgtgtggagttaccacctcatgggagggatctgcacctcggactgtcttgtgggggaatacagagtgggagagggagagaagtttaactgtgaaaaatgccacgagagctgcatggaatgcaagggaccaggggccaagaactgcaccttgtgccctgccaacctggtgctgcacatggacgacagccactgcctccactgctgcaacacctctgatccccccagtgcccaggagtgctgtgactgccaggacaccacggacgaatgcatccttcgaacaagcaaggttaggcctgcaactgagcatttcaagacagctctgttcatcacctcctccatgatgctggtgcttctgctcggggcagctgtggtagtgtggaagaaatctcgtggccgagtccagccagcagcaaaggccggctatgaaaaactggccgaccccaacaagtcttactcctcctataagagcagctatagagagagcaccagctttgaagaggatcaggtgattgagtacagggatcgggactatgatgaggatgatgatgatgacatcgtctacatgggccaggatggcacagtctaccggaaatttaaatatgggctgctggatgacgatgacatagatgagctggaatatgatgacgagagttactcctactaccagtaa

SEQ ID NO: 107 - DNA, 5862 bp, Artificial Sequence
  Synthetic Construct
atgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacagagtttgccttctgccaggtggatgcctccatcgctctggccctggccctggccgtcctgtgtgatctgctccagcagtgggaccagttggcccctggactgcccatcctgctgggatggctgttgggagagagtgatgacctcgtggcctgtgtggagagcatgcatcaggtggaagaagactacctgtttgaaaaagcagaagtcaacttttgggccgagaccctgatctttgtgaaatacctctgcaagcacctcttctgtctcctctcaaagtccggctggcgtcccccaagccctgagatgctctgtcaccttcaaaggatggtgtcagagcagtgccacctcctgtctcagttcttcagagagcttccaccagctgctgagtttgtgaagacagtggagttcacaagactacgcattcaagaggaaaggactttggcttgcttgaggctgctggcctttttggaaggaaaggaaggggaagacaccctagttctcagtgtttgggactcttatgcagaatcgaggcagttaactcttccaagaacagaagcggcatgttga

SEQ ID NO: 108 - protein, 793 aa, Artificial Sequence
  Synthetic Construct
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKQAEGGRRHGYMGHLTRIANCIVHSTDKGPNSALVQQLIKDLPDEVRERWETFCTSSLGETNKRNTVDLAFSDYQMQQMTSNFIDQFGFNDEKFADQDDIGNVSFDRVSDINFTLNTNESGNIALFEACCKERIQQFDDGGSDEEDIWEEKHIAFTPESQRRSSSGSTDSEESTDSEEEDGAKQDLFEPSSANTEDKMEVDLSEPPNWSANFDVPMETTHGAPLDSVGSDVWSTEEPMPTKETGWASFSEFTSSLSTKDSLRSNSPVEMETSTEPMDPLTPSAAALAVQPEAAGSVAMEASSDGEEDAESTDKVTETVMNGGMKETLSLTVDAKTETAVFKSEEGKLSTSQDAACKDAEECPETAEAKCAAPRPPSSSPEQRTGQPSAPGDTSVNGPV

SEQ ID NO: 109 - protein, 432 aa, Artificial Sequence
  Synthetic Construct
MPRPGKSSYSDQKPPYSYISLTAMAIQHSAEKMLPLSDIYKFIMERFPYYREHTQRWQNSLRHNLSFNDCFIKIPRRPDQPGKGSFWALHPDCGDMFENGSFLRRRKRFKVLRADHTHLHAGSTKSAPGAGPGGHLHPHHHHHPHHHHHHHAAAHHHHHHHPPQPPPPPPPPPPHMVHYFHQQPPTAPQPPPHLPSQPPQQPPQQSQPQQPSHPGKMQEAAAVAAAAAAAAAAAVGSVGRLSQFPPYGLGSAAAAAAAAAASTSGFKHPFAIENIIGRDYKGVLQAGGLPLASVMHHLGYPVPGQLGNVVSSVWPHVGVMDSVAAAAAAAAAAGVPVGPEYGAFGVPVKSLCHSASQSLPAMPVPIKPTPALPPVSALQPGLTVPAASQQPPAPSTVCSAAAASPVASLLEPTAPTSAESKGGSLHSVLVHS

SEQ ID NO: 110 - protein, 953 aa, Artificial Sequence
  Synthetic Construct
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 111 - protein, 1009 aa, Artificial Sequence
  Synthetic Construct
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 112 - protein, 245 aa, Artificial Sequence
  Synthetic Construct
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSAMATYSATCANNSPAQGINMANSIANLRLKAKEYSLQRNQVPTVN

SEQ ID NO: 113 - protein, 589 aa, Artificial Sequence
  Synthetic Construct
MSQRVRRNGSPTPAGSLGGGAVATAGGPGSRLQPMRATVPFQLKQQQQQQHGSPTRSGGGGGGNNNGGCCGGASGPAGGGGGGGPRTASRSTSPTRGGGNAAARTSPTVATQTGASATSTRGTSPTRSAAPGARGSPPRPPPPPPLLGTVSSPSSSPTHLWTGEVSAAPPPARVRHRRRSPEQSRSSPEKRSPSAPVCKAGDKTRQPSSSPSSIIRRTSSLDTLAAPYLAGHWPRDSHGQAAPCMRDKATQTESAWAEEYSEKKKGSHKRSASWGSTDQLKEIAKLRQQLQRSKHSSRHHRDKERQSPFHGNHAAINQCQAPVPKSALIPVIPITKSTGSRFRNSVEGLNQEIEIIIKETGEKEEQLIPQDIPDGHRAPPPLVQRSSSTRSIDTQTPGGADRGSNNSSRSQSVSPTSFLTISNEGSEESPCSADDLLVDPRDKENGNNSPLPKYATSPKPNNSYMFKREPPEGCERVKVFEECSPKQLHEIPAFYCPDKNKVNFIPKSGSAFCLVSILKPLLPTPDLTLKGSGHSLTVTTGMTTTLLQPIAVASLSTNTEQDRVSRGTSTVMPSASLLPPPEPIEEAEG

SEQ ID NO: 114 - protein, 479 aa, Artificial Sequence
  Synthetic Construct
MSDGFDRAPGAGRGRSRGLGRGGGGPEGGGFPNGAGPAERARHQPPQPKAPGFLQPPPLRQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 115 - protein, 271 aa, Artificial Sequence
  Synthetic Construct
MEHGSIITQARREDALVLTKQGLVSKSSPKKPRGRNIFKALFCCFRAQHVGQSSSSTELAAYKEEANTIAKSDLLQCLQYQFYQIPGTCLLPEVTEEDQGRICVVIDLDETLVHSSFKPINNADFIVPIEIEGTTHQVYVLKRPYVDEFLRRMGELFECVLFTASLAKYADPVTDLLDRCGVFRARLFRESCVFHQGCYVKDLSRLGRDLRKTLILDNSPASYIFHPENAVPVQSWFDDMADTELLNLIPIFEELSGAEDVYTSLGQLRAP

SEQ ID NO: 116 - protein, 1860 aa, Artificial Sequence
  Synthetic Construct
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 117 - protein, 1953 aa, Artificial Sequence
  Synthetic Construct
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 118 - DNA, 4542 bp, Artificial Sequence
  Synthetic Construct
atggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 119 - DNA, 2757 bp, Artificial Sequence
  Synthetic Construct
atgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 120 - DNA, 1722 bp, Artificial Sequence
  Synthetic Construct
atgtcccagcgggtgaggcgcaatgggtcccccacgccggccggctcccttgggggtggtgcggtggccacggccgggggacccgggagccgcttgcagcccatgagggcgacggttccgttccagctgaagcagcagcagcagcagcaacatggcagccccacgcggagcggcggcggcggcggcggcaacaacaacggtggctgctgtggtggcgcctcaggccccgcaggcggcggcggcggcggtggcccgcgcaccgcctcgcgcagcaccagccccacgcgcggcggcgggaacgcggccgcgcgcaccagccccacggtggccacgcagacgggcgcgtccgcgacgtccacgcgaggcaccagccccacgcgcagcgccgcgcctggagctcgcgggagccccccacggccgccgccgccgccgccgctgctgggcaccgtgtcgtcgcccagctcgtcgcccacccacctgtggaccggcgaggtgagcgcggccccacccccagcccgcgtccggcatcggaggaggtctccggagcagagccgaagctcgccggagaagaggagccccagcgccccggtttgcaaagcagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 121 - DNA, 2574 bp, Artificial Sequence
  Synthetic Construct
atgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 122 - DNA, 1137 bp, Artificial Sequence
  Synthetic Construct
atggaacacggctccatcatcacccaggcgcggagggaagacgccctggtgctcaccaagcaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 123 - DNA, 4464 bp, Artificial Sequence
  Synthetic Construct
atgggctgggggagccgctgctgctgcccgggacgtttggacctgctgtgcgtgctggcgctgctcgggggctgcctgctccccgtgtgtcggacgcgcgtctacaccaaccactgggcagtcaaaatcgccgggggcttcccggaggccaaccgtatcgccagcaagtacggattcatcaacataggacagataggggccctgaaggactactaccacttctaccatagcaggacgattaaaaggtcagttatctcgagcagagggacccacagtttcatttcaatggaaccaaaggtggaatggatccaacagcaagtggtaaaaaagcggacaaagagggattatgacttcagtcgtgcccagtctacctatttcaatgatcccaagtggcccagcatgtggtatatgcactgcagtgacaatacacatccctgccagtctgacatgaatatcgaaggagcctggaagagaggctacacgggaaagaacattgtggtcactatcctggatgacggaattgagagaacccatccagatctgatgcaaaactacgatgctctggcaagttgcgacgtgaatgggaatgacttggacccaatgcctcgttatgatgcaagcaacgagaacaagcatgggactcgctgtgctggagaagtggcagccgctgcaaacaattcgcactgcacagtcggaattgctttcaacgccaagatcggaggagtgcgaatgctggacggagatgtcacggacatggttgaagcaaaatcagttagcttcaacccccagcacgtgcacatttacagcgccagctggggcccggatgatgatggcaagactgtggacggaccagcccccctcacccggcaagcctttgaaaacggcgttagaatggggcggagaggcctcggctctgtgtttgtttgggcatctggaaatggtggaaggagcaaagaccactgctcctgtgatggctacaccaacagcatctacaccatctccatcagcagcactgcagaaagcggaaagaaaccttggtacctggaagagtgttcatccacgctggccacaacctacagcagcggggagtcctacgataagaaaatcatcactacagatctgaggcagcgttgcacggacaaccacactgggacgtcagcctcagcccccatggctgcaggcatcattgcgctggccctggaagccaatccgtttctgacctggagagacgtacagcatgttattgtcaggacttcccgtgcgggacatttgaacgctaatgactggaaaaccaatgctgctggttttaaggtgagccatctttatggatttggactgatggacgcagaagccatggtgatggaggcagagaagtggaccaccgttccccggcagcacgtgtgtgtggagagcacagaccgacaaatcaagacaatccgccctaacagtgcagtgcgctccatctacaaagcttcaggctgctcggataaccccaaccgccatgtcaactacctggagcacgtcgttgtgcgcatcaccatcacccaccccaggagaggagacctggccatctacctgacctcgccctctggaactaggtctcagcttttggccaacaggctatttgatcactccatggaaggattcaaaaactgggagttcatgaccattcattgctggggagaaagagctgctggtgactgggtccttgaagtttatgatactccctctcagctaaggaactttaagactccaggtaaattgaaagaatggtctttggtcctctacggcacctccgtgcagccatattcaccaaccaatgaatttccgaaagtggaacggttccgctatagccgagttgaagaccccacagacgactatggcacagaggattatgcaggtccctgcgaccctgagtgcagtgaggttggctgtgacgggccaggaccagaccactgcaatgactgtttgcactactactacaagctgaaaaacaataccaggatctgtgtctccagctgcccccctggccactaccacgccgacaagaagcgctgcaggaagtgtgcccccaactgtgagtcctgctttgggagccatggtgaccaatgcatgtcctgcaaatatggatactttctgaatgaagaaaccaacagctgtgttactcactgccctgatgggtcatatcaggataccaagaaaaatctttgccggaaatgcagtgaaaactgcaagacatgtactgaattccataactgtacagaatgtagggatgggttaagcctgcagggatcccggtgctctgtctcctgtgaagatggacggtatttcaacggccaggactgccagccctgccaccgcttctgcgccacttgtgctggggcaggagctgatgggtgcattaactgcacagagggctacttcatggaggatgggagatgcgtgcagagctgtagtatcagctattactttgaccactcttcagagaatggatacaaatcctgcaaaaaatgtgatatcagttgtttgacgtgcaatggcccaggattcaagaactgtacaagctgccctagtgggtatctcttagacttaggaatgtgtcaaatgggagccatttgcaaggatggagaatatgttgatgagcatggccactgccagacctgtgaggcctcatgtgccaagtgccagggaccaacccaggaagactgcactacctgccccatgacaaggatttttgatgatggccgctgtgtttcgaactgcccctcatggaaatttgaatttgagaaccaatgccatccatgccaccacacctgccagagatgccaaggaagtggccctacccactgcacctcctgtggagcagacaactatggccgagagcacttcctgtaccagggagagtgtggagatagctgcccagagggccactatgccactgaggggaacacctgcctgccctgcccagacaactgtgagctttgccacagcgtgcatgtctgcacaagatgcatgaagggctacttcatagcgcccaccaaccacacatgccagaagttagagtgtggacaaggtgaagtccaagacccagactatgaagaatgtgtcccttgtgaagaaggatgtctgggatgcagcttggattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 124 - protein, 1513 aa, Artificial Sequence
  Synthetic Construct
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 125 - protein, 918 aa, Artificial Sequence
  Synthetic Construct
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSNFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 126 - protein, 573 aa, Artificial Sequence
  Synthetic Construct
MSQRVRRNGSPTPAGSLGGGAVATAGGPGSRLQPMRATVPFQLKQQQQQQHGSPTRSGGGGGGNNNGGCCGGASGPAGGGGGGGPRTASRSTSPTRGGGNAAARTSPTVATQTGASATSTRGTSPTRSAAPGARGSPPRPPPPPPLLGTVSSPSSSPTHLWTGEVSAAPPPARVRHRRRSPEQSRSSPEKRSPSAPVCKADFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 127 - protein, 857 aa, Artificial Sequence
  Synthetic Construct
MSDGFDRAPGAGRGRSRGLGRGGGGPEGGGFPNGAGPAERARHQPPQPKAPGFLQPPPLRQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 128 - protein, 378 aa, Artificial Sequence
  Synthetic Construct
MEHGSIITQARREDALVLTKQGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 129 - protein, 1487 aa, Artificial Sequence
  Synthetic Construct
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 130 - DNA, 7299 bp, Artificial Sequence
  Synthetic Construct
gcggcgccgcgggctggaggccggcgtcggggaaggtcctggtgccggattccgcacgaggtgttgacgggcggcttctgccaacttctccccagcgcgcgccgagcccgcgcggccccggggctgcacgtcccagatacttctgcggcgcaaggctacaactgagacccggaggagactagaccccatggcttcctggacgagcccctggtgggtgctgatagggatggtcttcatgcactctcccctcccgcagaccacagctgagaaatctcctggagcctatttccttcccgagtttgcactttctcctcagggaagttttctggaagacacaacaggggagcagttcctcacttatcgctatgatgaccagacctcaagaaacactcgttcagatgaagacaaagatggcaactgggatgcttggggcgactggagtgactgctcccggacctgtgggggaggagcatcatattctctgcggagatgtttgactggaaggaattgtgaagggcagaacattcggtacaagacatgcagcaatcatgactgccctccagatgcagaagatttcagagcccagcagtgctcagcctacaatgatgtccagtatcaggggcattactatgaatggcttccacgatataatgatcctgctgccccgtgtgcactcaagtgtcatgcacaaggacaaaacttggtggtggagctggcacctaaggtactggatggaactcgttgcaacacggactccttggacatgtgtatcagtggcatctgtcaggcagtgggctgcgatcggcaactgggaagcaatgccaaggaggacaactgtggagtctgtgccggcgatggctccacctgcaggcttgtacggggacaatcaaagtcacacgtttctcctgaaaaaagagaagaaaatgtaattgctgttcctttgggaagtcgaagtgtgagaattacagtgaaaggacctgcccacctctttattgaatcaaaaacacttcaaggaagcaaaggagaacacagctttaacagccccggcgtctttctcgtagaaaacacaacagtggaatttcagaggggctccgagaggcaaacttttaagattccaggacctctgatggctgatttcatcttcaagaccaggtacactgcagccaaagacagcgtggttcagttcttcttttaccagcccatcagtcatcagtggagacaaactgacttctttccctgcactgtgacgtgtggaggaggttatcagctcaattctgctgaatgtgtggatatccgcttgaagagggtagttcctgaccattattgtcactactaccctgaaaatgtaaaaccaaaaccaaaactgaaggaatgcagcatggatccctgcccatcaagtgatggatttaaagagataatgccctatgaccacttccaacctcttcctcgctgggaacataatccttggactgcatgttccgtgtcctgtggaggagggattcagagacggagctttgtgtgtgtagaggaatccatgcatggagagatattgcaggtggaagaatggaagtgcatgtacgcacccaaacccaaggttatgcaaacttgtaatctgtttgattgccccaagtggattgccatggagtggtctcagtgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagagactgcacagacacaactcactactgtatgtttgtaaaacatcttaatttgtgttctctagaccgctacaaacaaaggtgctgccagtcatgtcaagagggataaacctttggaggggtcatgatgctgctgtgaagataaaagtagaatataaaagctcttttccccatgtcgctgattcaaaaacatgtatttcttaaaagactagattctatggatcaaacagaggttgatgcaaaaacaccactgttaaggtgtaaagtgaaattttccaatggtagttttatattccaattttttaaaatgatgtattcaaggatgaacaaaatactatagcatgcatgccactgcacttgggacctcatcatgtcagttgaatcgagaaatcaccaagattatgagtgcatcctcacgtgctgcctctttcctgtgatatgtagactagcacagagtggtacatcctaaaaacttgggaaacacagcaacccatgacttcctcttctctcaagttgcaggttttcaacagttttataaggtatttgcattttagaagctctggccagtagttgttaagatgttggcattaatggcattttcatagatccttggtttagtctgtgaaaaagaaaccatctctctggataggctgtcacactgactgacctaagggttcatggaagcatggcatcttgtccttgcttttagaacacccatggaagaaaacacagagtagatattgctgtcatttatacaactacagaaatttatctatgacctaatgaggcatctcggaagtcaaagaagagggaaagttaaccttttctactgatttcgtagtatattcagagctttcttttaagagctgtgaatgaaactttttctaagcactattctattgcacacaaacagaaaaccaaagccttattagacctaatttatgcataaagtagtattcctgagaactttattttggaaaatttataagaaagtaatccaaataagaaacacgatagttgaaaataatttttatagtaaataattgttttgggctgatttttcagtaaatccaaagtgacttaggttagaagttacactaaggaccaggggttggaatcagaatttagtttaagatttgaggaaaagggtaagggttagtttcagttttaggattagagctagaattgggttaggtgagaaagaaagttaaggttaaggctagagttgtctttaagggttagggttaggaccaggttaggtcagggttggattgggtttagattggggccagtgctggtgttagtgatagtgtcaggatggaggttaggtttggagtaagcgttgttgctgaagtgagttcaggctagcattaaattgtaagttctgaagctgatttggttatggggtctttcccctgtatactaccagttgtgtctttagatggcacacaagtccaaataagtggtcatacttctttattcagggtctcagctgcctgtacacctgctgcctacatcttcttggcaacaaagttacctgccacaggctctgctgagcctagttcctggtcagtaataactgaacagtgcattttggctttggatgtgtctgtggacaagcttgctgagtttctctaccatattctgagcacacggtctcttttgttctaacttcagcttcactgacactgggttgagcactactgtatgtggagggtttggtgattgggaatggatgggggacagtgaggaggacacaccagcccattagttgttaatcatcaatcacatctgattgttgaaggttattaaattaaaagaaagatcatttgtaacatactctttgtatatatttattatatgaaaggtgcaatattttattttgtacagtatgtaataaagacatgggacatatatttttcttattaacaaaatttcatattaaattgcttcactttgtatttaaagttaaaagttactatttttcatttgctattgtactttcattgttgtcattcaattgacattcctgtgtactgtattttactactgtttttataacatgagagttaatgtttctgtttcatgatccttatgtaattcagaaataaatttactttgattattcagtggcatccttataaa

SEQ ID NO: 131 - DNA, 5240 bp, Artificial Sequence
  Synthetic Construct
ccggcgggaagtgagccagggcttggcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacctctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagctcgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccatttgaagtttttactcgtctctattaatatttaaataaatgctggggggtgatagttcttctttttaaaataaacattttcttttgaataagcatgttttgctgccgctgcaagtgttgtggccgttgtttctcagaacgtctgaggcagcagctgaatcatctcagtgcaagagcttctgagcataacacgaaacccagaagccaaaggaagagccacgcgtgggcccttgtgaaactaaagcttttcgtgtaagacaacacaaacaaaatttaaagacaaatgacggggaaaagaggagaaaatatattacaaaggattagtatccatcataccaaatacccgtgaaccagtcagaaacatcccagggggcaggtggaccaaggatgtgaacaggctagtctcagaagaagaaatacacatgctcatggcccggcactgtggctcacgcctgggatcccagcactttgggaggccgaggcaggtggatcacgaggtcaggagtttgagaccagcctgcccaacatggtgaaaccccgtctctactaaaaatacaaaaattagccaggcgtggtgtacaggcacgcctgtagtcccagctactcaggaggctgaggcaagagaatcgcttgaacccaggaggcggaggttgcagtgagccgagatcgtgccactgcactccagcctgggtgacagagcaagactccgtctcaaaaaaaaaaaaaaaaaaagaaatatacatgctctgcaaatatgtgaaaaaggtcaatctccatgaataaaaatatgataaaacca

SEQ ID NO: 132 - DNA, 8543 bp, Artificial Sequence
  Synthetic Construct
cacctacctccccgccgctccagagggggctcgcagagctgaggacgcgcgcagcgctgctcaaggtctctctctctcagcaccctcgccggccggcgtctgacgcgggtgccagggtctccgggcacctttcagtgtccattccctcagccagccaggactccgcaacccagcagttgccgctgcggccacagcccgaggggacctgcggacaggacgccggcaggaggaggggtgcgcagcgcccgcgcagagcgtctccctcgctacgcagcgagacccgggcctcccggccccaggagcccccagctgcctcgccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccagctctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgcctgcgcacgggggcggtcattgcctcgccggagcagctccaggccgcctacgaagcaggctatgagcagtgtgacgccggctggctgcgggaccagaccgtcagataccccattgtgagcccccggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgctacgctggccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccactgtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattataatattataataataataaagacattggaagagat

SEQ ID NO: 133 - DNA, 12478 bp, Artificial Sequence
  Synthetic Construct
gcgcgcgcgcctgctcgcctgcagccggggagtcgcgcggggcggggccgcgtgcgcggggtcgggggcgcgcgaccgaagcggataagggacgcggcggcggttggctgtgtctgttgagagagtacaggacagcccggactgcgagaggcggcggcggaggcagtagttgcaccggcagaggcggccgctggcagcggttgaggcggcggtccaacgcgtgctctctgggcggggtgcggcgggggatgtgcctgctcaggccgggcggagtctctctgacagggcgggggatgcgccgcggccgctcgcccggaccctgaggctgctgggcccaccctcccggaaccgtccgaccctcggtggcctcggcctcttctgccatctccggtcctaccctggggcggagggtggaaggcagcttccgtcgaagaggagggggctgcggtggccaccgcggcggagcccgagttattttaccaagaaaatggtttgcacgactttgaacatatactatccatgctgatgggacaggatccaatatgaatataaatgatggaggaagacgacgctttgaagataatgaacatacattacggatatatcctggggctatttcagaagggacaatctactgtccgattcctgccagaaaaaactccacagctgctgaggtgattgagtctcttataaacaaacttcatcttgacaaaacaaaatgttatgttctagcagaggtaaaggaatttggtggagaagaatggattctcaatccaacagattgtccagttcagcgaatgatgctgtggccccgaatggctctggaaaatcgcttaagtggagaggactaccgcttccttctgagagagaaaaaccttgatggatcaatccattatggtagcctgcagtcatggctacgggtaacagaagaacgtcgcaggatgatggaacggggttttcttccacagcctcaacagaaagactttgatgatttatgtagtttacctgatttgaatgagaaaactctcttagaaaacctacgaaatcgctttaagcatgaaaaaatttatacctatgttggcagtattctaatagttattaacccattcaagtttcttcctatttataaccccaaatatgtcaaaatgtatgataaccaccaactgggaaaacttgagccccacatttatgctgtggctgatgtagcttatcatgccatgcttcagcgcaaaaagaatcagtgcatcgtgatttcaggagagagtggttctgggaagactcaaagcacaaactttcttattcaccaccttactgctctcagtcagaaaggatttgccagtggagtagaacagattattcttggagctggaccagtacttgaggcctttggaaatgcaaagacagctcataataacaattcaagtcgttttgggaagtttattcaagtaaattaccaggaaacaggcactgtacttggtgcctatgttgaaaaatatctactggagaagtccagactcgtttatcaggagcataatgaacggaactatcatgtattctattacctcctggcaggagcaagtgaagatgagagatcagcattccatcttaagcaaccagaggaatatcattatctcaatcagataacaaagaaacccctcagacagagctgggatgattattgctatgactctgagccggattgcttcacggtggaaggagaagatttgagacatgactttgagcgcctacaacttgccatggaaatggtaggatttcttcccaagacacgaagacagattttctctcttctctcagccatactacatttgggtaatatctgttacaaaaagaagacataccgggatgactccattgatatctgtaatcctgaagttctgcctattgtctcagaattattagaggttaaagaagagatgctatttgaagcattagttacaaggaagacggtgacagtgggagaaaagcttattttgccatacaagttggcagaggctgtgacagtgaggaactccatggctaagtctctgtatagtgccctgtttgactggatagtttttcgaattaatcatgcacttctgaatagtaaagatttagagcataataccaagacattgtctattggtgttcttgatatttttgggtttgaagattatgaaaataacagctttgaacagttctgtattaattttgctaatgaacgtttacagcactactttaatcagcatatctttaaattggaacaagaggaatatagaactgaaggtatcagctggcacaacatagattacattgataatacctgctgcataaatcttattagcaaaaaaccaacaggactgcttcatcttttggatgaagaaagcaactttccacaggctacaaatcaaacattgctagacaagtttaagcatcaacatgaagataattcttacatcgaatttccagccgtgatggagcctgctttcattataaaacattatgctggaaaagtaaaatatggggtaaaggatttccgggaaaaaaatacagatcatatgcgcccagacattgtagctcttctgagaagcagcaagaatgcatttatctctgggatgattggaattgatcctgtagctgttttccgatgggcaattctccgagcttttttcagagccatggttgctttcagggaagctgggaaaagaaacattcacagaaaaactggacatgatgatacagcgccatgtgcaattttgaaaagtatggatagttttagctttctccaacacccagtccaccagaggagcttagagattctgcagagatgcaaggaagagaagtacagtataacccggaaaaatcccagaacacctctttctgatctccagggcatgaatgctctaaatgaaaaaaaccaacatgatacatttgatattgcctggaatggcagaactgggattcgccagagcagactatcaagtggcacctccttgcttgataaagatggaatatttgctaattcaactagcagcaaactcctggagagagcccatggaattctcacgagaaacaaaaatttcaaatccaagcctgcccttccaaagcacttgctagaagtaaattctttaaagcacctgacaagactgacactacaagatcgcattaccaagtctcttcttcatttacacaagaagaaaaaacctcccagcatcagtgcccagtttcaggcatcattaagcaagctaatggaaacacttggtcaagcagaaccatattttgtaaaatgcattcgctctaatgctgaaaagctgcccttaaggttcagtgatgtcttggtacttagacagcttcgatacaccgggatgctggaaacagttcgaattcgccaatcaggatacagctccaaatattctttccaggattttgtgagccacttccatgtacttcttccccgaaatattattccatccaaatttaacattcaggatttcttcaggaaaataaatcttaatccagataattatcaagttggaaaaaccatggtctttctaaaggagcaggaacgacagcacttacaagatctgcttcaccaagaggtgctccgcagaatcatattgttgcagcgatggttcagggtcttgctgtgtaggcagcatttcctccatctgagacaagcatctgttattatccagagattctggaggaattacctaaatcagaagcaagtcagagatgcagctgtgcagaaggatgcttttgttatggctagtgcagctgctcttctccaagcttcctggcgtgctcacttagagaggcagcggtacttggagttacgggctgcagccatcgttatccagcagaaatggagagattactataggcgcaggcacatggctgctatttgcatacaagcaagatggaaagcctacagggaaagtaaaaggtaccaagaacaaaggaaaaaaattatccttttgcaatcaacatgtagaggattcagagcaagacaaagatttaaagctttaaaagaacaaaggctaagagaaacaaagccagaagttggattggtgaatattaagggatatggatctctggaaattcagggttcagacccttcaggatgggaggattgttcttttgacaacagaataaaagccatagaggaatgtaaatctgtaatagagagtaatcgaattagccgtgaaagttcagtggactgcttgaaggagtcaccaaacaagcagcaggagagagcccaaagccagagtggtgtggacttgcaggaagatgtgcttgtaagagagagacccagatccttggaggatctccatcagaaaaaagtaggccgggctaagagagaaagtaggagaatgagagaactagagcaagctatatttagcttagaattgctgaaagttcgttctcttggtggtatttctccttcagaggatcgcagatggtctacagaattggtgcctgaaggccttcagtctccacggggtacacctgatagtgagagctctcaaggaagcttggaacttctgagctatgaggaaagccaaaagagcaaactagagtctgtcatttcagatgaaggagacttgcagtttccatcacctaagatatccagcagtccaaaatttgattcacgggacaatgccctcagtgcctcaaatgagactagcagtgcagagcatttgaaggatggaactatgaaggaaatggtggtctgcagttctgagtctattacctgtaaaccacagctgaaagactccttcatttcaaatagtctacctacttttttttatatcccccaacaagacccactgaaaacaaattcccaactagacacaagtatccaaagaaacaaactattggaaaatgaagacacagcgggggaagctcttactttggatatcaacagggaaactagaaggtatcactgctcaggaaaagatcagattgttccttctttgaatacagagtcttctaatcctgtgcttaagaagttagaaaagctaaacactgagaaggaagaaaggcaaaaacagttgcagcaacagaatgaaaaagagatgatggaacagattcgccagcaaacagatattttagagaaggagcgcaaagccttcaagacaattgaaaagccaagaattggagagtgtttggtggcaccatcttcctatcagtcaaagcaaagagtagagaggccatcctctctcctcagcttaaatacctcaaataagggagaacttaatgtactggggtccctatcattaaaagatgcagctcttgcccaaaaagacagttcctctgctcacttacccccaaaggaccgacctgtcaccgtgttctttgaaagaaaaggaagtccatgccaatctagtactgtcaaggaattatccaagacagacagaatgggcacccagctgaatgtagcctgtaaactctcaaataatcgcatttcaaaaagagaacactttaggccaactcagtcttacagccacaattctgatgacctttccagagagggaaatgctaggcccattttcttcactccaaaggacaatatgagtattccccttgtcagcaaagaagccttaaacagtaaaaatcctcaactccataaagaagatgaaccagcatggaaacctgtgaagttagctgggccaggccaaagagagacatcacagcgattttcgtcagttgatgaacaagcaaaacttcataagactatgtctcaaggagagattaccaagttggcagtgagacagaaggcttcagattcagatataagacctcagagagctaagatgagattctgggccaaagggaaacaaggggagaagaagactaccagagtgaaacctactacccagtcagaggtttcgccactctttgcaggcacagatgtgattccagctcatcagtttccagatgaattagctgcatatcacccaacacctcctttgagcccagaactgcccggcagttgccggaaggaattcaaagagaacaaagaaccttctccaaaggctaagcgcaagcgaagtgtgaagattagcaacgtggctttggattctatgcattggcaaaatgactctgtccagatcatagcaagtgtcagtgatttaaaaagcatggatgaatttcttctgaaaaaggtgaatgacctagataatgaagacagcaagaaggatacactagtggatgttgtatttaaaaaagccctgaaggaatttcggcagaatatcttcagcttttattcatctgcattggcgatggatgatgggaaaagcatacggtataaagacctctatgcactatttgaacagattctggaaaagacgatgaggcttgagcagcgtgattcactgggtgaatctccagtgagagtttgggtcaacacttttaaagtgtttttagatgaatatatgaatgaattcaagacttcagattgcacagccacaaaggtgccaaaaacagaaagaaagaaaagaaggaaaaaggaaactgatttggtggaagaacacaatggtcacatctttaaagccacccaatatagcatccctacatactgtgaatactgttcttctttgatatggataatggaccgagcctctgtttgcaaattatgcaagtatgcttgccataagaagtgctgtctgaaaaccacagccaagtgctctaaaaagtatgatccagagctgtcatctcgacaatttggggttgaactgtcccgtttgaccagtgaagaccgaactgttcctttagtagtggaaaagctcataaactacattgaaatgcatggactgtatacagaaggtatttatcgaaagtctggttcgactaataaaatcaaggagcttcggcagggtctagatacagatgctgagagtgtaaatctagatgactataacatacacgtcattgcaagtgtattcaaacaatggcttcgagatttgcccaatcctctcatgacctttgaactctatgaggaatttcttcgagctatgggccttcaggagaggaaggagacaatccgtggtgtatactctgtgattgatcaactctcccgaactcatctcaatacactggaacgcctcatctttcatctagtcaggattgctctgcaggaagacactaatcgaatgtctgctaatgctttggccattgtgtttgcgccctgcattctccgctgccctgacaccactgacccactacaaagtgtacaggacatcagtaagactaccacttgtgtggaactgattgttgtggaacaaatgaataaatacaaggctcgtctcaaagatatcagtagcttggaatttgctgagaataaggcaaagaccaggttgtcactgattcgtagatcaatgggaaaggggcgtattcgtcgaggaaactatccaggtccatcgtctcctgttgtagttcggttgccttctgtgtctgatgtctcagaggagaccttgactagtgaggcagccatggagactgacatcacagaacagcagcaagcagctatgcagcaggaggagagagtactgactgagcagattgagaacctacagaaggagaaggaggagctaacatttgagatgcttgtactggaaccccgtgcctctgatgatgaaacccttgagtctgaggcctccattgggactgctgatagctcagagaatttgaatatggagtctgaatatgctatctctgagaaatcagaaagaagcttagcccttagctccctgaagacagctggcaagtctgaaccttccagcaagttgcgaaagcaacttaaaaagcagcaagactctttagatgtcgtggactcttcggtctcctctttatgtctgtctaacacggcatcatctcatgggaccagaaaactatttcagatttattccaaatctccattctaccgagctgcctcaggtaatgaggccctgggaatggaaggaccattgggccagaccaaattcctggaagacaagcctcagttcatcagcagaggaaccttcaacccggaaaagggcaaacaaaaattaaagaatgtgaaaaactcacctcagaaaaccaaagagaccccagaggggacagtcatgtctggccgcagaaaaactgtggacccagactgcacctccaaccaacagctagcactctttggaaataatgaatttatggtctgaaccggcagatgtgtgtccctccgtggctacagagtggtaaacaaatctcacctttggggctgcgtttcatcacctcgtccacaatagtcaatcctaattgtggtcctgcctcttttctaagcatatggctaagactgtatgtgctgaattcctgggcctcctgcagaagcagaaagcctgctggggatggtgccagctgtgccttggctgttgtatttgaattgagatttttactatacaaagccacctagggcctggggatttgggtcagttgtagttgcctctcccccaccctcttttcccttcccaaaggtgggtgttgaactaggggggatattgctgtcctgagggaccctctcatttctgacatttgaagaaaacgtataaatctttcttaaccgtgaaagcaaaagcctttgggtttattttgggatagttaggagctagggtagaatataatttttttccaaaaacttacttacaaacaaaaagcctaatccctctattttaagatttctgaaaaaacactccatgttatattctggggaaagcaaaaacaaaaaaaaaaaacaaaaaaaaaaaaacaaaaaaaaaccgtgattgtttccattaagccatcagagcgtgtctcagatatcttgttatacagtgaagaagagaatacctattttttttgatgatgtttgatgtcatagtaatcagtgctggtttaactcctgtttagttcctgccaaatacattgcatgggctgaagtgtcagtagccatactgttctcatgtttcttggtcctaggatcagattcttctacattattttttagtttcccagagacatggtgatccctaaacttatgaaggtttcatcctaagccattcaggcttttctctttgtatagattaaaccgaaaaccgcatatgagcctgttcatctgctggtggattcccaccacagactcagactcaaacaaacaaacaaataatgtgaccgtttagttagtttccaaaaacattcacatacaatattgcatgaataagtaagtaagtgttacagaaagctgccaaaaaataaaaaggtttttaatatgacctatctaactaactaacttttatcttccttttctcagactatcagtattaaatagatggaaaaaaatcaaggactacttgaagctatttttgttaatattctggttactgaagtttattgtaaatatgtatgtatagtaggcatatttctttttaaccttgtgcttccctccttcccatggaatttcttcccacagatgaggggccactggacagggggatgagagccattcgtccctgggttgagggaattagtaagacatcattttcaccactgggtggtcttcatacacatgagttataatagcattttaagtatcttagcatttgtgggattagaaatctgtttttgctatttataatatataaaaaatgaaacatgatagcctttcttgagataagtatgtgaaatgtttatttttaaagttactaaatgcatcttgtcttgctactacatgcactgctctgaaaaagagcctttaccatctataacctgtattttgggtattcttccttttcatacttctttgaagttgtggaaatattaagtcttttgttaaggcagagtctctctctcctgttacacaacactgaacctcacgccactgcctcagtggttattggccagccccagaggttagacttggagcataattctgagtggcagctaaaggtagcaggagtcttacctctccctactttgggttcagaattgagccagagaaaggaagccattaaaatctccagaataatgatagttaatgagcaaatgttatgctttatatcccacagacatctgccaccttgttcatcttgtcctgaggagtaataaataatgttaagcttttaaaaatctgaatttcagagaatctcctagaggatagaggaaaacccctcagcatggtgtgttagagtgggattgctggttcctcagccccgtgccaggttgcacagtctgtgtttcagtgttcttgggagagtagtgtactgctgggcattaattgttactctgcacttgctccagaatgttggttaaatcctgtatgaaaaaaagagattgcccttatggaataatttcctgtggcccagaggaatggccagaagaacatatgttggcacatgttcttccttctaaatctttgtggggcttttttggcaaaataagttttttggcagttaaaaaacgactgatgtaggtcactttaaaggaactaggtgatggatgttaagagactttataatttttctcagggacctgaaactccagtttggataaaattcaattaaaaaaacttgttttttcagttgctagatttgtggatttctagtaatttaatctgccaggattggggtgggtgggtgaggaggagagagccacaaaatgataagagtggagagcagtgtggggccctccctttgagggaaagccgttgtttacatagggtagtaggccttgttggcctgatcaagagatgaagccataactcttaaaaaccttcagaaccaaacgctgtgtctgcatccatctgttctcactggccctctgcatggtaaagttatgtcaccacaaagtgatgccgcattacaatcacttatgaaactgttagcccttaatatgcatcacatttgtggttccatagtgcttctcctttgcttgtttgatctctgcatggcagcagtggggcagctccacatttggagcccatactccaaaatgcagagcactcttctcacagcacacattcccagccccaaacaaaacctgaattttcaactctgcccattaaagtgaatgtatccctgtaatttagtatgtacttattatggaaaatgtaacaaaagcagagaagtgtgatttcattctgtatcacaaattgaagcaaatcaacagcaaatacagcaggattcagggaggcttagtttacaacgtactttgtacctcctgccatttaaattattttgccactctgggcttctgaaaacacaaagggagatacagccctccaactatgagccttgcagagagagacaaaagggccagaggtcctgggatggaatactagagcccccaccttctcatgctttggaaacctgccagagcacttaccctgctggaagattaatgaagactccattctgtgtttcataacagtagcgttgttttctccatcaaaaacagagggtcacagaaatgtgctgaaaagatgtggtccagcaaggttctgtagtcccacctcagtgcctgtgggctgtgtttttcactgtaacaagcactttggtaaactagaaagaagaaaggattctcaggatgtgttcaaagctaagagagttttcattttaaaaagaaacatacatactcactccatggctttcctcatcctcctctcttttttcttcttggtgggaagctggatgcggggcatgcatcattctgtatggacaaatgtgttatgtccacccatactcttgtgacaactccccagcactgtcctgcaataccatgctggccttggtagtaaaactccttggtatctgtgagagtcctctttttctatgccctagactacttttaaccacttttctctggaatgactcccacatttgattgggtattgaaagggtaacagcaaaatgatgattgtggagatggatctattaggtctcatgttggtcccctggttgaaactattttcaaaaaagccccaacaatgggcctgtcaccttgctagtcatccattcttaatgcctatttatcagccctctgaggtcatataaaagttgcaccttttgaaccaagtatttgtatttactatgggaaaggtgtggactacagattcgtattatattattttaatggattttaagtaatttataagtatgctgagtgtaaattttttttaaaaactgtattataaaaggacatatcctgtgaaatataacattttactgtttaatagaataattctataagaagaatgatttatctcacccacggaactgattacattccggatgcaatcaataggcactttgtaatttcctttttgtttttttttctttgctggggggttgaggggtaacaagataccatctgtataaagtgcagtttgtgtcactcaaaatatgcactgtatggctacacaaaagcagcttgatgaacaaatcaccccatggctcattaaagaacaaagcttccagaagca

SEQ ID NO: 134 - DNA, 4446 bp, Artificial Sequence
  Synthetic Construct
atgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccaaggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaa

SEQ ID NO: 135 - DNA, 8281 bp, Artificial Sequence
  Synthetic Construct
aagtgccgtttcggtttaatctagtgtgtgactgggtctgtgtgagggagagagtgtgtgtggtgtggaggtgaaacggaggcaagaaagggggctacctcaggagcgagggacaaagggggcgtgaggcacctaggccgcggcaccccggcgacaggaagccgtcctgaaccgggctaccgggtaggggaagggcccgcgtagtcctcgcagggccccagagctggagtcggctccacagccccgggccgtcggcttctcacttcctggacctccccggcgcccgggcctgaggactggctcggcggagggagaagaggaaacagacttgagcagctccccgttgtctcgcaactccactgccgaggaactctcatttcttccctcgctccttcaccccccacctcatgtagaagggtgctgaggcgtcgggagggaggaggagcctgggctaccgtccctgccctccccacccccttcccggggcgctttggtgggcgtggagttggggttgggggggtgggtgggggttgctttttggagtgctggggaacttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggagatgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccaaggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtgggggattgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctctctctctctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcattgtattttggttatcagcagtcatcaataatgtttttccctcccctctcccacctcttatttttaattatgccaaatatcctaaataatatacttaagcctccattccctcatccctactagggaagggggtgagtgtatgtgtgagtgtatgtgtatgtatgatcccatctcacccccacccccattttgggagtcttttaaaatgaaaacaaagtttggtagttttgactatttctaaaagcagaggagaaaaaaaaacttatttaaatatcctggaatctgtatggaggaagaaaaggtatttgttaatttttcagttacgttatctataaacatgatggaagtaaaggtttggcagaatttcaccttgactatttgaaaattacagacccaattaattccattcaaaagtggttttcgttttgttttaattattgtacaatgagagatattgtctattaaatacattattttgaacagatgagaaatctgattctgttcatgagtgggaggcaaaactggtttgaccgtgatcatttttgtggttttgaaaacaaatatacttgacccagtttccttagttttttcttcaactgtccataggaacgataagtatttgaaagcaacatcaaatctatacgtttaaagcagggcagttagcacaaatttgcaagtagaacttctattagcttatgccatagacatcacccaaccacttgtatgtgtgtgtgtatatataatatgcatatatagttaccgtgctaaaatggttaccagcaggttttgagagagaatgctgcatcagaaaagtgtcagttgccacctcattctccctgatttaggttcctgacactgattcctttctctctcgtttttgacccccattgggtgtatcttgtctatgtacagatattttgtaatatattaaatttttttctttcagtttataaaaatggaaagtggagattggaaaattaaatatttcctgttactataccacttttgctccattgcatt

SEQ ID NO: 136 - DNA, 3363 bp, Artificial Sequence
  Synthetic Construct
atggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaagttaaggtacatggacagcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagaggagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtag

SEQ ID NO: 137 - DNA, 3643 bp, Artificial Sequence
  Synthetic Construct
agccggccccgccccctggcgcgcgggcgtgtcggacccgcagagctctcggactttcggaagctctcggtgtgggtgcgacccgagagaaggagcggggctggtggggctgctgcagccgtcacaggaaataagtaatcatggtgctcaacagtttggataagatgattcaactccagaaaaacactgccaacatcaggaatatttgtgttttggctcatgttgaccatggaaaaactactctggctgactgtcttatatctagcaatggaatcatctccagccgcctagcaggcaagttaaggtacatggacagcagagaagatgaacagatccgagggatcactatgaaatccagtgccatttccctacattatgcaacaggtaatgaggagtacctgatcaatctgatagactctccaggacacgtggacttttcctcagaagtatcaaccgctgttcgcatttgtgatggatgcatcattgtggtagatgctgtggaaggagtctgtccacagacacaggcagttctgcgacaagcttggcttgaaaacatccgtccggttttagtgattaataagattgatcgcttgatagtggaactgaaattcaccccacaagaggcctattctcacctcaagaatattttagaacagattaatgcgctcacagggactctttttacttctaaagtcctagaagaaagagcagagagggagactgaatcccaagtgaatccaaattctgaacaaggagagcaagtatatgactggagcactggcttggaggacacagatgattctcacctttacttctctccagaacagggaaatgtggtgtttaccagtgcaatagatgggtggggctttggaattgagcacttcgccagaatctacagtcaaaaaattggcatcaaaaaggaagttcttatgaaaaccttgtggggagattactatataaatatgaaggctaaaaagatcatgaagggtgatcaggccaaaggaaagaaacctttatttgtacagttgatcctggaaaatatatggagtttgtatgatgctgttttgaaaaaggacaaagacaaaattgataaaatagtgacttctttaggattaaaaattggagcccgggaggcacgacattcagaccctaaagttcagatcaacgccatttgcagtcagtggctacccatatcccatgctgttcttgctatggtgtgtcagaaacttcctagtccccttgatattacagctgagagagtggagagactgatgtgcacaggatcacaaacttttgactcttttccaccagaaactcaagcactgaaagcagcttttatgaaatgtggaagtgaggacactgctccagttattatatttgtttccaaaatgtttgcagttgatgctaaggccttgcctcagaataagccaaggcctctcactcaagaagaaattgctcagagacgtgagcgtgcaagacaaaggcatgcagagaagcttgcagcagcacagggacaggcacccttggagcccacccaagatgggagtgccattgaaacatgtccaaaaggagaggagccaagaggtgacgagcaacaggtggaaagtatgacccctaaacctgtgctccaggaagaaaacaaccaagagtcttttattgcatttgctcgggtgttcagtggtgtggctcgaagaggaaagaaaatttttgtcttggggcccaaatacagtcctcttgagtttttacgaagggtaccattaggcttctcagctccaccagatggcctcccccaagtcccccacatggcatactgtgctctggaaaacctgtatcttctgatgggaagggaactggaatatctagaggaggtacctccaggaaatgtgctaggaataggaggccttcaagattttgtgctgaaatctgcaacactgtgtagcctgccatcctgcccaccatttataccactcaacttcgaagccactcctattgtgagagttgctgttgaaccaaaacatccaagtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtagctacctactactggtggattcttttccttatagtgaatttaaaagtatcatcaagggtttaatattgggaaaatttctttttgccacattatctctgtttattcactttcaataaagttgatccatataaatattttaaa

SEQ ID NO: 138 - DNA, 15674 bp, Artificial Sequence
  Synthetic Construct
agacggcggtgggacggccaggccccggccccgccagtgtgtccgcccggccccgcgtcccggagcgcccgcacccggccccgccgccgcctcagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagtccttaccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttccaggctacttgaaattgacatttccagcaacaagttgtcccacctccctcctggattcttgcacctctcaaaacttcaaaaactgacagcttcaaaaaattgtttagaaaaattgttcgaagaagaaaatgccactaactggataggtttacggaagctacaggaacttgatatatctgacaataaattgacagaactccctgccctgttccttcactctttcaagtccctcaattctctgaatgtctccagaaacaacctgaaggtgtttccagatccctgggcctgccctttgaaatgttgtaaagcttccagaaatgccctggaatgtctgccagacaaaatggctgtcttttggaaaaatcacctgaaggatgtggatttctcagaaaacgcactcaaagaagttcccctgggacttttccagcttgatgccctcatgttcttgaggttacaggggaaccagctggcggcacttccacctcaagagaagtggacctgcaggcagctcaaaaccctggatctctccagaaaccaacttggcaaaaatgaagatggactgaaaacgaagcgtattgcctttttcaccaccagaggtcgccagcgctccgggactgaggcagcaagtgtgctggaatttccggccttcctaagtgagtctttggaagtcctttgcctgaacgacaaccacctcgacacagtccctccctcggtttgcctactgaagagcttatcagagctctacttgggaaacaaccctggcctccgggagctccctcctgagctggggcagctgggcaacctctggcagctggacactgaagacctgaccatcagcaatgtgcctgcagaaatccaaaaagaaggccccaaagcaatgctgtcttacctgcgtgctcagctgcggaaagcggaaaagtgcaagctgatgaagatgatcatcgtgggtcccccgcgccagggcaagtccaccctcctggagatcttacagacggggagggccccccaggtggtgcatggagaggccaccatcaggaccaccaagtgggagctccagaggccggctggctcgagagccaaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaagctgtggcctctgtcttttgagcgcttatgaccacagcacgggctcagtccctcccagacccactcgctgtctggggataatgggcagcccctccttgcccactgtgccaacatgcaggtggcccctgagcagcttccatgggtggagacgctgctctgtcagtcacaggcttggaaaaagcgagtccccccactcttttttttttttttttttttttttttaccaacctgggcaccaagtcccagggggctgagggtctgtgcttcctgtctacctccctgccattctctcaccctcatcccacagcagggtctcaggagtcccactctccctctcctctcattccagtgccccacaactgcccagttaacccccagatgcaagccagattccatctgccccaggccccaagcttttgctttggcatcacgcgaggccaggctgctttgcaggcaccaaaattcaccctctcctactcctggaaaagcccagccccaggcctcacagagccaggggaggggatctcatcacatcacagttagaaatcatacaggcctaaagtcccagctacccaggagccaaggcaggaggaacccttgagcctgggagttggaggttacagtgagctatgatcacaccagctttctagcctgggtgacagagcaagacccaactcttaaaaaaaaaaaaaaaatacaggaaatgactaatgaacttgactccatgaaattgaaacttacgtggaaaattagtccaaagcctaaaagactagcaactgagaaaaaaaaacattgcaacacaaatgagagacaaagacctcacttatcttcattacagagagttcgtaatgtcaataagaaacagaaaaccggaaaggcaaacaggttaagggcatgggcagcaattgaattacaaagaaacagacagacccttaaacatcaatgcttgacctcacccaacagcagggaaacagtctccacaacagtaaaatgttgctgggatgggcccagcattcagcatggtccctgcaactttggcctctgcccagtgacctctggcgggtgtagaagagctcatgcttcagtgagggggtggggggcaccctgaggaccctgtcaacatcagctggaccacaggcatctcagatagatgtcacttaccaccctcatgttggcagagggtggtaaccagccagcatctccttcttaaacacctactaagtgtcaggcactgtgaccggagacacagtcaagaatctctgtgttttttttgttttgttttgtttttgttttttgagacggagtctcgctctgttgcccaggctggagtgcaatggcgcgatctcagctcactgccacctccgcctcccaggttcaagcaattctcctgcctcagcctcccgagtagctgcgattacaggcgtgcaccacaatgcctggataatttttgtattttcagtagaaacggggtttcaccatgttggccaggatggtcttgaactcctgagctcaggtgatccgcccgcctcatcctcccaaagtgctgggattacaggtgtgagctacctgcgctggccgaatctctgcttttaggagctcactcctcataggtagagttgacaataagcacacaaacaagtgagatagcagggcagccggaccacccagttgggcaattcgtggcttggcctaggaacgttacatttgactgaggctggcgaggcctgcagcctgcaccaggaggtacaatgtgagactgaggaatgggaagaaggcattccatggagctctgagggcactgggtgcaagggccttgcacatgcaaagaccctgttgtgggttcaagccactgtgtgggagggacaggagagcctggcgtggctgcggccttgaaggaggggactgtgcacacagaattgcaagtgggggtctccgcggaagctcctggcagttttaagcaggattattagatgattcagtcaactttacaactcactttgctgaatggagggtggattaacgagggggtagttggaggctaccccttggagggcattctggacttatctaccaaaatttcaaatgcacataccctctgacccagcagttccacttaagtatttggtcctgaaatcttggtaaaagtgcccaaagatacagaacaaggatgttcactatagcatctcttagaatatggccccaaacaggaagcaaccccaacctctatcatgagggaggtcataaaattcctgcacatgcaacagtgccatcctctgcagcctgtcaaagaggcaggcagcactaactgctggactggaatgttctccaagatataataaatgcatttgtttgaaagcagcttgcagcacagtgcgtcaggcctctgagcccaagccaagccatcgcatcccctgtgacttgcacgtatatgcctagatggcctgaagtaactgaagaatcacaaaagaagtgaatatgccctgccccgccttaactgatgacattccaccacaaaagaagtgaaaaaggccggtccttgacttaactgatgacattatcttatgaaattccttctcctggctcatcctggctcaaaaagctcccccactgagcacgttgccacccccactcctgcccgccagagaacaaaccccctttttcctttacctacccaaatcttataaaacggcctcacgcctatctcccttcactgactcccttttcggactcagcccacctgcgcccaggtgaaataaacagccttgttgctcacacaaagcctgtttggtggtctcttcacatggacgtgcattaaatttggtgccgtaactggcgcggggggaggggggggggaacctcccttgggagatcaatcccctgtcctcctgctctttggtccatgagaaagatccacctacaacctcaagtcctcagaccaaccagcccaagaaacatctcaccaatttcaaatccagtaagcagcctctttttactctcttctccaacctccctcactatccctcaacctctttctcctttcaatcttggcgccacacttcaatttctcccttctcttaacttcaattcctttcattttctggtagagataaaggagacacgttttatccgtggacccaaaactccagcgccggtcacggactgggaaggcagccttcccttggtgtttaatcattgcagggacacctctctgattattcacccaggtttcagaggtgtcagaccacgcagggacgcctgccttggtccttcacccttagcggcaagtcccgcttttctggggaatgggcaaggaccccaaccccttctctccgtgtctctaccccttctccgcctttctggggggcaagaaacccccaaccccttctccttcaccctgagcggcaagtcccgcttttctagaggaggagcaagtactccaacctcatatctctgcgccccaatcccttatttctgtgccccaacctcttatctctgtgccccaatcccttatttccatgcccccacctcttatatctctgcaccttgatcccttatttccacatcccgacctcgtatctctgcaccccgacccctttcccacttttctggagagtaagaacccctgaaccgcttctctccgtgtctctactctcccttttctttaaacttgcctccttcactgtaggcaaccttccactctccattcctccttcttctcccttagcctatgttctcaaaaacttaaaacctcttcaactcacacctgacctaaaacctaaatgccttattttcttctgcaatgccgcttgaccccaatacaaactcaacagtagttccaaatagccggaaaacagcactttcaatttttccatcctgcaagatctaaataattcttgtcgtaaaatgggcaaatggtctgaggtgcctgacgtccaggcgttcttttacacatcagtccctccctagtctctgttcccagtgcaactcatcccaaatcttccttctttccctcccgcctgtctcctcagtcccaaccccaagcatcgctgagtctttctaatcttttctatagacccatctgacctctcccctcctccccaggctgctccttgccaggccgagctaggtcccaattcttcctcagcctccgctcctccaccatataatctttttatcacctcccctcctcacacccggtccggcttacagtttccttccgtgactagccctcccctacctgcccagcaattttctcttaaaaaggtggctggagctaaaggcatagtcaaggttaatgctcctttttctttatcccaaatcagatagcgtttaggctctttttcatcaaatataaaaacccagcccagttcatgcctcgtttggcagcaaccctgagacactttacggccctagaccctaaaagcccaaaaggccgtcttattctcaatatatattttatcacccaatctgctccctacattaaataaaactccaaaaattaaattccggccctcaaaccccacaacaggatttaattaaccttgccttcaaggtgtacaataatagaaaaaagttgcaattccttgcctccactgtgagacaaaccccagccacatctccagcacacaagaacttccaaacacctgaactgcagcggccaggcattcctccagaacctcctcccccaggagcttgctacaagtgccagaaatctggccaccaggccaaggaatgcctgcagcccaggattcctcctaagccgtgtcccatctgtgcgggaccccactggaaatcggactgtccaactcacctggcagccactcccagagcccctggaactccggcccaaggctctctgactgactccttcccagatcttcttggcttagcggctgaagactgacactgcccgatcacctcggaagccccctagaccatcacggacgccgagctgccagtaactctcacagtggaaggtaaacccgtccccttcttaatcaatacggaggctacccactccacattaccttcttttcaagggcctgtttcccttacctccataactgttgtgcgtattgacagccaggcttctaaacctcttaaaactccccaactctggtgccaacttagacaatactcttttaagcactccttttagttatccccagctgcccagttcccttattaggctgagacactttaactaaattatctgcttccctgactattcctgggctacagccacacctcattactgcccttcttcccaatccaaagcctcctttgtgtcctcctcttgtatcccccgaccttaacccataagtataagatacctctactccctccttggtgaccgatcatgcaccccttaccatctcatcgaaacctaatcacccttaccccgctcaacaccaatatcccatcccacagcatgctttgaaaagactaaagcctgttatcactctcctgctacagcatggccttttaaagcctataaactctccttacaattcccccatttcacttgtcctaaaaccagacaagccttacaagttagttcaggatctgtgccttatcaaccacattgttttgcctatccaccccatggtgtcaaacccatatactctcctatcctcaatacctcactccataatccattattgtgttctggatctcaaacatgctttctttactattcctttgcacccttcatcccagcctctcttcactttcacttggactgaccctgacacccatcaggctcagcaaattacctgggctgtactgccccaaagcttcacagacagcccccattacatcagtcaagcccaaattttttccctatctgttacctatctcagcataattctcataaagacacacgtgctctccctgccgatcatgtccgattaatctcccaaaccccaaccccttctacaaaacaagaactcctttccttcctaggcatggttagtgcagtcagaattcttacacaagagccaggaccgcaccctgtagaccttctgtccaaacaacttgaccttactgttttagcctagccctcatgtctctgtgcagcggctgctgccaccctaatacttttagaggccctcaaaatcacaaactatgctcaactcactctctacagttatcataacttccaaaatctattttcttcctcatacctgacatatatactttctgctccccggctccttcagctgtactcactctttattgagtctcccacaattaccatttttcctggcaccgacttcaatccagcctcccacattattcctgataccacacctgacccccatgactgcatctctctgatccacctgacgttcaccccatttccccacatttccttcttccctgcttctcaccctgatcacacttggtttatggatggcagttccaccaggcctaatggccacacaccagcaaaggcaggctgtgctatagtacaagccgctagcccgcctcttagaacctctcatttcctttccatcgtggaaatctatcctcaaggaaataacttctcagtgttccatctgctattctactgctcctcagggattattcaggccccctcccttccctacacatcaagctcagggatttgcctccacccaggactggcaaattgactttactcaacatgccccgagtcagataactaaaatacctcttattctaggtagacactttcactggataggtagaggcctttcctacagggtctgagaaggccaccatggtcatttcttcccttctgtcaaacataattcctcggtttggccttcccacctctatactgtctgataacagaccagcctttattagtcaaatcagccaagcgttttttcaggctcttagtattcagtgaaacctttatatcccttacagtcctcagccttcaggaaaggtagaacggactaatgatcttttaaaaacacacctcaccaagctcagccaccaacttaaaaaagactggacaatacttttaccactttcccttctcagaattcaggcctgtccttggaatgctacaaggtacagcccatttgagctcctgtatagacgctcctttttattaggccccagtctcattccagacaccagaccaacttggactgtgccccaaaaaacttgtcatccctactatcttctgtctagtcgtactcctattcaccattctcaactactcatacgtgccctgctcttgtttacactgccagtttacactgtttctccaagccatcacagctgatatctcctggtgctatccccaaaccgccactctgaactcttaaatacataatctttgctggcaggactatgctgaacctcctttggcactctctaatcagatgtcctgagtcatctcaattcttagaccttttatacctgtttttctcctttacttattccgtttagtttttcaattcatacaaaaccgtatccaggtcatcaccaataattctaaatgacgaatgtttcttctaacaaccgcacaatatcaccccttaccacaagacctcccttcagcttaatctctcccactctaggttcccacgccgccccgaatcccgctcgaagcagccctgagaaacatcgcccattctctctctccacaccgccccccaaaaattttcgctgccccaacacttcgacactattttgttttatttttcttattaatataagaaggcaggaatgtcaggcctctgagcccaagctaagccatcgcatcccctgtgacctgcacgcatatataagcccagatggcctgaagtaactgaagaatcacaaaagaagtgaatatgccctgccccaccttaactgatgacattccaccacaaaagaagtgtaaatggctggttcttgccttaagtgatgacattaccttgtgaaagtccttttcctggctcatcctggctcaaaaagcacccccactgagcaccttgccgcccccactcctgcccgccagagaacaaaccccctttgactgtaattttcctttacctacccaaatcctataaaacggccccacccccatctccctgcactgactctcttttcggactcagcccgcctgcacccaggtgaaataaacagctttattgctcacacaaa

SEQ ID NO: 139 - DNA, 1263 bp, Artificial Sequence
  Synthetic Construct
atgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtatcagtcagagccggatctctcattggctgttgcagcagggatcagacctgagtgaacagaagaaaagagcattttaccgatggtatcaacttgagaagacaaaccctggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaagttacttcaatgagaatcaatacccagatgaagcaaagagggaagaaattgcaaacgcttgcaatgcagttatacagaagccaggcaaaaagctgtcagatctggaaagagttacctccctgaaagtatataattggtttgctaacagaaggaaggagatcaagaggagagccaatattgaagcagcaatcctggagagtcatgggatagatgtgcagagtccaggaggccactcaaacagtgatgatgtcgacgggaatgactactctgagcaggatgacagtacgagccatagtgaccaccaagaccccatctcattagctgtggaaatggcagcagtcaaccacactatcttggcattggcccgacaaggagccaacgaaatcaagacagaggccctggatgatgactga

SEQ ID NO: 140 - DNA, 1443 bp, Artificial Sequence
  Synthetic Construct
atggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactga

SEQ ID NO: 141 - DNA, 2781 bp, Artificial Sequence
  Synthetic Construct
atgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatga

SEQ ID NO: 142 - DNA, 1002 bp, Artificial Sequence
  Synthetic Construct
atggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagtgcccttaaagatagccgttttcccccaatgacaagggatgagctgccacggcttttctgctcagtgtctctgctcactaactttgaagatgtctgtgattatttggactgggaggtgggtgtacatggcattagaatagaattcatcaatgaaaaaggatcaaaacgcaccgccacctacctaccggaggttgcaaaggagcaaggatgggaccatatacagaccatagactccttattgaggaaaggaggatacaaagctccgattactaatgaattcaggaaaaccataaaactgaccaggtatcgtagtgaaaagatgaccctgagctatgctgaataccttgctcatcgccagcatcatcatttccaaaatggcattgggcatccccttccgccatacaaccattattcctga

SEQ ID NO: 143 - DNA, 5889 bp, Artificial Sequence
  Synthetic Construct
atgagagaattggaagctaaagctaccaaagacgtagaaagaaatcttagcagggatttagtgcaagaagaagaacagttgatggaagaaaagaaaaagaaaaaagacgacaagaaaaagaaggaagctgctcaaaagaaggccactgaacaaaaaatcaaagtgccagaacagataaagcccagtgtaagccagcctcagcctgccaactctaataacggcacttccacagcaaccagcactaataataatgccaagcgagctacagccaacaatcagcagccacagcagcagcagcaacagcagcagccgcagcagcagcagccacagcagcagccacagccgcagccgcagcagcagcagccacagcagcagccacaggccttgcctcggtatcctcgtgaagtacctccacgatttcgccaccaggaacacaaacagcttctaaagaggggtcagcattttcctgttatagcagcaaaccttggatctgctgttaaggtgttaaacagccagtcagaaagcagtgctttaacaaatcaacagccacaaaataacggagaggtgcagaacagcaaaaaccagtcagatataaaccacagtacttcaggatcccattatgaaaattcccagcggggacctgtgtcttctacaagtgattctagcacaaactgtaagaatgctgttgtaagtgacttgtcggaaaaagaagcatggccctcagcccctggcagtgatccggagttggcttcagaatgtatggatgctgattctgcctccagttctgaatcagagagaaacatcactatcatggcttcagggaacacaggtggtgaaaaagatggccttcggaatagcactggacttggttcccaaaacaagtttgtagttggtagcagcagcaataatgtgggccatggaagtagtactgggccatggggtttttcccatggagccataataagcacatgtcaggtctctgtggatgctcctgaaagcaaatctgaaagtagcaacaatagaatgaatgcttggggcactgtaagttcttcatcaaatggagggttaaatccaagcactttgaattcagctagcaaccatggtgcctggccagtattagagaacaatggacttgccctaaaagggcctgtagggagtggtagttctggcattaatattcagtgcagtactataggccagatgcctaacaatcagagtattaactctaaagtgagtggtggttctacccatggtacctggggaagccttcaggaaacttgtgaatctgaagtaagtggtacacagaaggtttcattcagtggtcaacctcaaaatattaccactgaaatgactggaccaaataacactactaactttatgacctctagtttaccaaactccggttcagtgcagaataatgagctgcctagtagtaacacaggggcctggcgtgtgagcacaatgaatcatcctcagatgcaggctccatcaggtatgaatggcacttccctttctcaccttagcaatggagagtcaaaaagtggaggctcttatggtactacatggggtgcctatggttctaattactctggagacaaatgttcaggccctaatggccaagctaatggtgacactgtgaatgcaactctaatgcagcctggcgtaaatggtcctatgggcactaactttcaagttaacacaaacaaaggaggtggtgtgtgggaatctggtgcagcaaactcccagagtacatcatggggaagtggaaatggcgcaaattctggaggaagtcgaagaggatggggaacccctgcacaaaacactggcactaatttacccagcgttgagtggaacaaactgcctagcaatcagcattccaatgatagtgcaaatggcaatggtaagacgtttacaaatggatggaaatctactgaggaagaggatcagggttctgccacatctcagacaaatgagcaaagcagtgtgtgggccaaaacaggaggtacagtggagagcgatggtagtacagaaagcactggacgccttgaggaaaaaggaactggggaaagtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagacttttaactcaggggcatgtatagataagactagccctaatggtaatgatacctcatctgtatcagggtggggcgatcccaaacctgctctgaggtggggagattccaaaggctcaaactgccagggggggtgggaagatgattctgctgctacaggaatggtcaagagcaatcagtgggggaattgcaaagaggagaaggctgcatggaatgactcgcaaaagaataaacagggatggggtgatggacaaaaatcaagccaagggtggtctgtttctgccagtgataactggggagaaacttcaaggaataaccattggggtgaggccaataagaaatccagctcaggaggtagtgacagtgacaggtccgtttccggttggaacgaacttggtaaaactagttctttcacttggggaaacaacataaatccaaataattcatcaggatgggatgaatcttctaaacctactccttcccagggatggggagaccctccaaagtctaatcagtctctaggttggggagattcgtcaaagccagtcagctctccagactggaacaagcaacaagacattgttggatcttggggaatcccaccagctacaggcaaacctcctggtacaggctggctggggggacctataccagccccagcaaaagaagaagaacccacaggctgggaggaaccatccccagaatctatacgtcgcaaaatggagattgatgatggaacttcagcttggggagatccaagcaaatacaactacaaaaatgtgaacatgtggaacaaaaacgtcccaaatggcaacagccgttcagaccagcaagcacaggtacatcagctgctaacgcctgcaagtgccatctcaaacaaagaggcaagcagtggctctggctggggtgagccctggggggagccttctactccagccacaactgtggataatggtacttcagcatggggtaagcccatagacagtggtcccagctggggggaacccattgctgcggcatccagcacatccacgtggggctccagctctgttggtccacaagcattaagcaaatctgggccaaaatctatgcaagatggctggtgtggtgatgatatgccattgcctggaaatcgccccactggctgggaagaggaagaggatgtggagattggaatgtggaatagtaattcatctcaagagcttaactcatctttaaattggccaccatatacaaagaaaatgtcatcgaagggtctgagtggcaaaaaaaggagaagggaaaggggaatgatgaaaggtggaaacaaacaagaagaagcgtggataaatccatttgttaaacagttttcaaacatcagtttttcgagagactcaccagaggaaaatgtacaaagcaataagatggacctttctggaggaatgttacaagacaaacgaatggagatagataaacatagcctaaatattggtgattacaatcgaacggtcgggaaaggccctggttctcggcctcagatttccaaagagtcttccatggagcgcaatccttattttgataaggatggcattgtagcagatgaatcccaaaacatgcagtttatgtccagtcaaagcatgaagcttcccccttcaaatagtgcactacctaaccaggcccttggctccatagcagggctgggtatgcaaaacttgaattctgttagacagaatggcaatcccagtatgtttggtgttggaaacacagcagcacaaccccggggcatgcagcagcctccagcacaacctcttagttcatctcagcctaatctccgtgctcaagtgcctcctccattactctcccctcaggttccagtttcattgctgaagtatgcaccaaacaacggtggcctgaatccactctttggccctcaacaggtagccatgctgaaccagctatcccagctaaaccagctttctcagatctcccagttacagcgattgttagcgcagcagcaaagggcgcagagtcagagaagcgtgccttctgggaaccggccgcagcaagaccagcagggtcgacctcttagtgtgcagcagcaaatgatgcaacaatctcgtcaacttgatccaaacctgttggtgaagcagcagactccaccatctcagcagcagccactccatcagccagccatgaagtctttccttgacaatgtcatgccccacactacacctgagctgcaaaaagggccatcaccaataaatgctttcagcaacttccctataggcttgaactcaaacttgaatgtaaatatggatatgaacagtattaaagagccacagtcaagactaaggaagtggacgacagtggacagcatttctgtgaacacatctttggatcaaaactccagcaaacatggtgctatttcaagtggtttcaggctggaagagtctccatttgttccctatgactttatgaacagcagtacttcaccagccagtcctccaggttcaataggagatggctggccacgtgccaaatcgcctaacggctctagcagtgttaattggccaccagaatttcgtcctggtgagccatggaaaggttatccaaacattgaccctgaaactgacccttacgtcactcctggcagtgtcataaacaatctttcaattaatactgtgcgggaagttgaccacctcagggacaggaacagtgggtcatcctcatccttgaacaccacgctgccttcaactagtgcctggtcatccattcgtgcctccaactacaacgttcccctcagcagtacagcacaaagcacttcagccagaaatagtgattccaaattgacatggtctcctggttcagttacaaacacctctctggctcatgagctgtggaaggtccctttgccacctaaaaacatcactgctccgtcccgcccacctccgggactgactggtcagaagccacccttgtctacgtgggataattctccccttcgtataggtggaggatggggaaattctgacgccagatataccccaggttccagctggggtgagagcagctcagggagaataacaaattggcttgttctaaaaaaccttacacctcagatcgatggctcaactctgcgcactctgtgcatgcagcacggcccgctgatcacattccacctgaacctccctcacggaaatgctctggtccgctacagttcaaaagaagaggtagtgaaggcacaaaagtctctgcacatgtgtgtactggggaacactactattcttgctgagtttgccagtgaagaggagatcagtcgtttctttgcacaaagccagtctctgaccccttctcccggctggcagtctctcgggtccagccagagccggctgggctccctcgactgttcccactcattctccagccggaccgatctcaatcactggaatggtgctgggctgtcgggaactaactgtggagaccttcacggcacttcactctgggggaccccgcattattccacaagcctgtggggtcccccaagcagcagcgacccccgaggaattagcagcccatctcccattaacgcttttctttctgttgaccacctgggtgggggtggagagtccatgtaa

SEQ ID NO: 144 - DNA, 4974 bp, Artificial Sequence
  Synthetic Construct
atgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaatacattttctgcattagcaaatatcgacctggctttagaacaaggagatgcactggccttgttcagggctctgcagtcaccagccctggggcttcgaggactgcagcaacagaatagcgactggtacttgaagcagctcctgagtgataaacagcagaagagacagagtggtcagactgaccccctgcagaaggaggagctgcagtctggagtggatgctgcaaacagtgctgcccagcaatatcagagaagattggcagcagtagcactgattaatgctgcaatccagaagggtgttgctgagaagactgttttggaactgatgaatcccgaagcccagctgccccaggtgtatccatttgccgccgatctctatcagaaggagctggctaccctgcagcgacaaagtcctgaacataatctcacccacccagagctctctgtcgcagtggagatgttgtcatcggtggccctgatcaacagggcattggaatcaggagatgtgaatacagtgtggaagcaattgagcagttcagttactggtcttaccaatattgaggaagaaaactgtcagaggtatctcgatgagttgatgaaactgaaggctcaggcacatgcagagaataatgaattcattacatggaatgatatccaagcttgcgtggaccatgtgaacctggtggtgcaagaggaacatgagaggattttagccattggtttaattaatgaagccctggatgaaggtgatgcccaaaagactctgcaggccctacagattcctgcagctaaacttgagggagtccttgcagaagtggcccagcattaccaagacacgctgattagagcgaagagagagaaagcccaggaaatccaggatgagtcagctgtgttatggttggatgaaattcaaggtggaatctggcagtccaacaaagacacccaagaagcacagaagtttgccttaggaatctttgccattaatgaggcagtagaaagtggtgatgttggcaaaacactgagtgcccttcgctcccctgatgttggcttgtatggagtcatccctgagtgtggtgaaacttaccacagtgatcttgctgaagccaagaagaaaaaactggcagtaggagataataacagcaagtgggtgaagcactgggtaaaaggtggatattattattaccacaatctggagacccaggaaggaggatgggatgaacctccaaattttgtgcaaaattctatgcagctttctcgggaggagatccagagttctatctctggggtgactgccgcatataaccgagaacagctgtggctggccaatgaaggcctgatcaccaggctgcaggctcgctgccgtggatacttagttcgacaggaattccgatccaggatgaatttcctgaagaaacaaatccctgccatcacctgcattcagtcacagtggagaggatacaagcagaagaaggcatatcaagatcggttagcttacctgcgctcccacaaagatgaagttgtaaagattcagtccctggcaaggatgcaccaagctcgaaagcgctatcgagatcgcctgcagtacttccgggaccatataaatgacattatcaaaatccaggcttttattcgggcaaacaaagctcgggatgactacaagactctcatcaatgctgaggatcctcctatggttgtggtccgaaaatttgtccacctgctggaccaaagtgaccaggattttcaggaggagcttgaccttatgaagatgcgggaagaggttatcaccctcattcgttctaaccagcagctggagaatgacctcaatctcatggatatcaaaattggactgctagtgaaaaataagattacgttgcaggatgtggtttcccacagtaaaaaacttaccaaaaaaaataaggaacagttgtctgatatgatgatgataaataaacagaagggaggtctcaaggctttgagcaaggagaagagagagaagttggaagcttaccagcacctgttttatttattgcaaaccaatcccacctatctggccaagctcatttttcagatgccccagaacaagtccaccaagttcatggactctgtaatcttcacactctacaactacgcgtccaaccagcgagaggagtacctgctcctgcggctctttaagacagcactccaagaggaaatcaagtcgaaggtagatcagattcaagagattgtgacaggaaatcctacggttattaaaatggttgtaagtttcaaccgtggtgcccgtggccagaatgccctgagacagatcttggccccagtcgtgaaggaaattatggatgacaaatctctcaacatcaaaactgaccctgtggatatttacaaatcttgggttaatcagatggagtctcagacaggagaggcaagcaaactgccctatgatgtgacccctgagcaggcgctagctcatgaagaagtgaagacacggctagacagctccatcaggaacatgcgggctgtgacagacaagtttctctcagccattgtcagctctgtggacaaaatcccttatgggatgcgcttcattgccaaagtgctgaaggactcgttgcatgagaagttccctgatgctggtgaggatgagctgctgaagattattggtaacttgctttattatcgatacatgaatccagccattgttgctcctgatgcctttgacatcattgacctgtcagcaggaggccagcttaccacagaccaacgccgaaatctgggctccattgcaaaaatgcttcagcatgctgcttccaataagatgtttctgggagataatgcccacttaagcatcattaatgaatatctttcccagtcctaccagaaattcagacggtttttccaaactgcttgtgatgtcccagagcttcaggataaatttaatgtggatgagtactctgatttagtaaccctcaccaaaccagtaatctacatttccattggtgaaatcatcaacacccacactctcctgttggatcaccaggatgccattgctccggagcacaatgatccaatccacgaactgctggacgacctcggcgaggtgcccaccatcgagtccctgataggggaaagctctggcaatttaaatgacccaaataaggaggcactggctaagacggaagtgtctctcaccctgaccaacaagttcgacgtgcctggagatgagaatgcagaaatggatgctcgaaccatcttactgaatacaaaacgtttaattgtggatgtcatccggttccagccaggagagaccttgactgaaatcctagaaacaccagccaccagtgaacaggaagcagaacatcagagagccatgcagagacgtgctatccgtgatgccaaaacacctgacaagatgaaaaagtcaaaatctgtaaaggaagacagcaacctcactcttcaagagaagaaagagaagatccagacaggtttaaagaagctaacagagcttggaaccgtggacccaaagaacaaataccaggaactgatcaacgacattgccagggatattcggaatcagcggaggtaccgacagaggagaaaggccgaactagtgaaactgcaacagacatacgctgctctgaactctaaggccaccttttatggggagcaggtggattactataaaagctatatcaaaacctgcttggataacttagccagcaagggcaaagtctccaaaaagcctagggaaatgaaaggaaagaaaagcaaaaagatttctctgaaatatacagcagcaagactacatgaaaaaggagttcttctggaaattgaggacctgcaagtgaatcagtttaaaaatgttatatttgaaatcagtccaacagaagaagttggagacttcgaagtgaaagccaaattcatgggagttcaaatggagacttttatgttacattatcaggacctgctgcagctacagtatgaaggagttgcagtcatgaaattatttgatagagctaaagtaaatgtcaacctcctgatcttccttctcaacaaaaagttctacgggaagtaa

SEQ ID NO: 145 - DNA, 1407 bp, Artificial Sequence
  Synthetic Construct
atgatgtattttgtgatcgcagcgatgaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctaccttaagagccttatgtggacgacatacagaaaagctaatggcatttaaagcaatatacccagacattgtgcgacttcattttcctccattatacaaggagttgttcacttcagaatttgagccagcaatgcaaattgatgggtaa

SEQ ID NO: 146 - DNA, 1059 bp, Artificial Sequence
  Synthetic Construct
atgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataa

SEQ ID NO: 147 - DNA, 453 bp, Artificial Sequence
  Synthetic Construct
atgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgctgtagctgtcgttgcttcccttccggtggaggtgaccagtttgtaa

SEQ ID NO: 148 - DNA, 3807 bp, Artificial Sequence
  Synthetic Construct
atggaccagaagattttatctctagcagcagaaaaaacagcagacaaactgcaagaatttcttcaaaccctgagagaaggtgatttgactaatctccttcagaatcaagcagtgaaaggaaaagttgctggagcactcctgagagccatcttcaaaggttccccctgctctgaggaagctggaacacttaggagacgtaagatatacacttgttgtatccagttggtggaatcgggggatttgcagaaagaaatagcgtctgagatcataggattactgatgctggaggctcaccattttccaggaccattattggttgaattagccaatgagtttattagtgctgtcagagaaggcagcctagtgaatggaaaatctttggagttactacctatcattctcactgccctggctacgaaaaaggaaaatctggcttatggaaaaggtgtactgagtggggaagaatgtaagaaacagttgattaacaccctgtgttctggcaggtgggatcagcaatatgtaatccaactcacctccatgttcaaggatgtccctctgactgcagaagaggtggaatttgtggtggaaaaagcattgagcatgttctccaagatgaatcttcaagaaataccacctttggtctatcagcttctggttctctcctccaagggaagcagaaagagtgttttggaaggaatcatagccttcttcagtgcactagataagcagcacaatgaggaacagagtggtgacgagctattggatgttgtcactgtgccatcaggtgaacttcgtcatgtggaaggcaccattattctacacattgtgtttgccatcaaattggactatgaactaggcagagaactcgtgaaacacttaaaggtaggacagcaaggagattccaataataacttaagtcccttcagcattgctcttcttctgtctgtaacaagaatacaaagatttcaggaccaggtgcttgatcttttaaagacttcggttgtaaagagctttaaggatcttcaactcctccaaggctcaaaatttcttcagaatctagttcctcatagatcttatgtttcaaccatgatcttggaagtagtgaagaatagcgttcatagctgggaccatgttactcagggcctcgtagaacttggtttcattttgatggattcatatgggccaaagaaggttcttgatggaaaaactattgaaaccagcccaagtctttctagaatgccaaaccagcatgcatgtaagctcggagctaatatcctgttggaaacttttaagatccatgagatgatcagacaagaaattttggagcaggtcctcaacagggttgttaccagagcatcttctcccatcagtcatttcttagacctgctttcaaatatcgtcatgtatgcacccttagttcttcaaagttgttcttctaaagtcacagaagcttttgactatttgtcctttctgccccttcagactgtacaaaggctgcttaaggcagtgcagccccttctcaaagtcagcatgtcaatgagagactgcttgatacttgtccttcggaaagctatgtttgccaaccagcttgatgcccgaaaatctgcagttgctgggtttttgctgctcctgaagaactttaaagttttaggcagcctgtcatcctctcagtgcagtcagtctctcagtgtcagtcaggttcatgtggatgttcacagccattacaattctgtcgccaatgaaactttttgccttgagatcatggatagtttgaggagatgcttaagccagcaagctgatgttcgactcatgctttatgaggggttttatgatgttcttcgaaggaactctcagctggctaattcagtcatgcaaactctgctctcacagttaaaacagttctatgagccaaaacctgatctgctgcctcctctgaaattagaagcttgtattctgacccaaggagataagatctctctacaagaaccactggattatctgctgtgttgtattcagcattgtttggcctggtataagaatacagtcatacccttacagcagggagaggaggaagaggaggaggaagaggcattctacgaagacctagatgatatattggagtccattactaatagaatgattaagagtgagctggaagactttgaactggataaatcagcagatttttctcagagcaccagtattggcataaaaaataatatctgtgcttttcttgtgatgggagtttgtgaggttttaatagaatacaatttctccataagtagtttcagtaagaataggtttgaggacattctgagcttatttatgtgttacaaaaaactctctgacattcttaatgaaaaagcgggtaaagccaaaactaaaatggccaacaagacaagtgatagtcttttgtccatgaaatttgtgtccagtcttctcactgctcttttcagagtcttgctatggagatacacttcaattcctacttcagtggaagagtcgggaaagaaagagaaaggaaagagcatctcactgctgtgcttggagggtttacagaaaatattcagtgctgtgcaacagttctatcagcccaagattcagcagtttctcagagctctggatgtcacagataaggaaggagaagagagagaagatgcagatgtcagtgtcactcagagaacagcattccagatccggcaatttcagaggtccttgttgaatttacttagcagtcaagaggaagattttaatagcaaagaagccctcctgctagtcacggttcttaccagtttgtccaagttactggagccctcctctcctcagtttgtgcagatgttatcctggacatcaaagatttgcaaggaaaacagccgggaggatgccttgttttgcaagagcttgatgaacttgctcttcagcctgcatgtttcgtataagagtcctgtcattctgctgcgtgacttgtcccaggatatccacgggcatctgggagatatagaccaggatgtagaggtggagaaaacaaaccactttgcaatagtgaatttgagaacggctgcccccactgtctgtttacttgttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataa

SEQ ID NO: 149 - DNA, 1596 bp, Artificial Sequence
  Synthetic Construct
atgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtga

SEQ ID NO: 150 - protein, 1691 aa, Artificial Sequence
  Synthetic Construct
MASWTSPWWVLIGMVFMHSPLPQTTAEKSPGAYFLPEFALSPQGSFLEDTTGEQFLTYRYDDQTSRNTRSDEDKDGNWDAWGDWSDCSRTCGGGASYSLRRCLTGRNCEGQNIRYKTCSNHDCPPDAEDFRAQQCSAYNDVQYQGHYYEWLPRYNDPAAPCALKCHAQGQNLVVELAPKVLDGTRCNTDSLDMCISGICQAVGCDRQLGSNAKEDNCGVCAGDGSTCRLVRGQSKSHVSPEKREENVIAVPLGSRSVRITVKGPAHLFIESKTLQGSKGEHSFNSPGVFLVENTTVEFQRGSERQTFKIPGPLMADFIFKTRYTAAKDSVVQFFFYQPISHQWRQTDFFPCTVTCGGGYQLNSAECVDIRLKRVVPDHYCHYYPENVKPKPKLKECSMDPCPSSDGFKEIMPYDHFQPLPRWEHNPWTACSVSCGGGIQRRSFVCVEESMHGEILQVEEWKCMYAPKPKVMQTCNLFDCPKWIAMEWSQCTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 151 - protein, 1417 aa, Artificial Sequence
  Synthetic Construct
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERDNSEKKKNLEEAELHSTEKVPCIEFDDDDYDTDFVPPSPEEIISASSSSSKCLSTLKDLDTSDRKEDVLSTSKDLLSKPEKMSMQELNPETSTDCDARQISLQQQLIHVMEHICKLIDTIPDDKLKLLDCGNELLQQRNIRRKLLTEVDFNKSDASLLGSLWRYRPDSLDGPMEGDSCPTGNSMKELNFSHLPSNSVSPGDCLLTTTLGKTGFSATRKNLFERPLFNTHLQKSFVSSNWAETPRLGKKNESSYFPGNVLTSTAVKDQNKHTASINDLERETQPSYDIDNFDIDDFDDDDDWEDIMHNLAASKSSTAAYQPIKEGRPIKSVSERLSSAKTDCLPVSSTAQNINFSESIQNYTDKSAQNLASRNLKHERFQSLSFPHTKEMMKIFHKKFGLHNFRTNQLEAINAALLGEDCFILMPTGGGKSLCYQLPACVSPGVTVVISPLRSLIVDQVQKLTSLDIPATYLTGDKTDSEATNIYLQLSKKDPIIKLLYVTPEKICASNRLISTLENLYERKLLARFVIDEAHCVSQWGHDFRQDYKRMNMLRQKFPSVPVMALTATANPRVQKDILTQLKILRPQVFSMSFNRHNLKYYVLPKKPKKVAFDCLEWIRKHHPYDSGIIYCLSRRECDTMADTLQRDGLAALAYHAGLSDSARDEVQQKWINQDGCQVICATIAFGMGIDKPDVRFVIHASLPKSVEGYYQESGRAGRDGEISHCLLFYTYHDVTRLKRLIMMEKDGNHHTRETHFNNLYSMVHYCENITECRRIQLLAYFGENGFNPDFCKKHPDVSCDNCCKTKDYKTRDVTDDVKSIVRFVQEHSSSQGMRNIKHVGPSGRFTMNMLVDIFLGSKSAKIQSGIFGKGSAYSRHNAERLFKKLILDKILDEDLYINANDQAIAYVMLGNKAQTVLNGNLKVDFMETENSSSVKKQKALVAKVSQREEMVKKCLGELTEVCKSLGKVFGVHYFNIFNTVTLKKLAESLSSDPEVLLQIDGVTEDKLEKYGAEVISVLQKYSEWTSPAEDSSPGISLSSSRGPGRSAAEELDEEIPVSSHYFASKTRNERKRKKMPASQRSKRRKTASSGSKAKGGSATCRKISSKTKSSSIIGSSSASHTSQATSGANSKLGIMAPPKPINRPFLKPSYAFS

SEQ ID NO: 152 - protein, 2431 aa, Artificial Sequence
  Synthetic Construct
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGQLYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACLRTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATLATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAATEESTEGPSATEVPSASEEPSPSEVPFPSEEPSPSEEPFPSVRPFPSVELFPSEEPFPSKEPSPSEEPSASEEPYTPSPPVPSWTELPSSGEESGAPDVSGDFTGSGDVSGHLDFSGQLSGDRASGLPSGDLDSSGLTSTVGSGLPVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 153 - protein, 2548 aa, Artificial Sequence
  Synthetic Construct
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSGWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQRETSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 154 - protein, 1481 aa, Artificial Sequence
  Synthetic Construct
MPNSERHGGKKDGSGGASGTLQPSSGGGSSNSRERHRLVSKHKRHKSKHSKDMGLVTPEAASLGTVIKPLVEYDDISSDSDTFSDDMAFKLDRRENDERRGSDRSDRLHKHRHHQHRRSRDLLKAKQTEKEKSQEVSSKSGSMKDRISGSSKRSNEETDDYGKAQVAKSSSKESRSSKLHKEKTRKERELKSGHKDRSKSHRKRETPKSYKTVDSPKRRSRSPHRKWSDSSKQDDSPSGASYGQDYDLSPSRSHTSSNYDSYKKSPGSTSRRQSVSPPYKEPSAYQSSTRSPSPYSRRQRSVSPYSRRRSSSYERSGSYSGRSPSPYGRRRSSSPFLSKRSLSRSPLPSRKSMKSRSRSPAYSRHSSSHSKKKRSSSRSRHSSISPVRLPLNSSLGAELSRKKKERAAAAAAAKMDGKESKGSPVFLPRKENSSVEAKDSGLESKKLPRSVKLEKSAPDTELVNVTHLNTEVKNSSDTGKVKLDENSEKHLVKDLKAQGTRDSKPIALKEEIVTPKETETSEKETPPPLPTIASPPPPLPTTTPPPQTPPLPPLPPIPALPQQPPLPPSQPAFSQVPASSTSTLPPSTHSKTSAVSSQANSQPPVQVSVKTQVSVTAAIPHLKTSTLPPLPLPPLLPGDDDMDSPKETLPSKPVKKEKEQRTRHLLTDLPLPPELPGGDLSPPDSPEPKAITPPQQPYKKRPKICCPRYGERRQTESDWGKRCVDKFDIIGIIGEGTYGQVYKAKDKDTGELVALKKVRLDNEKEGFPITAIREIKILRQLIHRSVVNMKEIVTDKQDALDFKKDKGAFYLVFEYMDHDLMGLLESGLVHFSEDHIKSFMKQLMEGLEYCHKKNFLHRDIKCSNILLNNSGQIKLADFGLARLYNSEESRPYTNKVITLWYRPPELLLGEERYTPAIDVWSCGCILGELFTKKPIFQANLELAQLELISRLCGSPCPAVWPDVIKLPYFNTMKPKKQYRRRLREEFSFIPSAALDLLDHMLTLDPSKRCTAEQTLQSDFLKDVELSKMAPPDLPHWQDCHELWSKKRRRQRQSGVVVEEPPPSKTSRKETTSGTSTEPVKNSSPAPPQPAPGKVESGAGDAIGLADITQQLNQSELAVLLNLLQSQTDLSIPQMAQLLNIHSNPEMQQQLEALNQSISALTEATSQQQDSETMAPEESLKEAPSAPVILPSAEQTTLEASSTPADMQNILAVLLSQLMKTQEPAGSLEENNSDKNSGPQGPRRTPTMPQEEAAEKRPPEPPGPPPPPPPPPLVEGDLSSAPQELNPAVTAALLQLLSQPEAEPPGHLPHEHQALRPMEYSTRPRPNRTYGNTDGPETGFSAIDTDERNSGPALTESLVQTLVKNRTFSGSLSHLGESSSYQGTGSVQFPGDQDLRFARVPLALHPVVGQPFLKAEGSSNSVVHAETKLQNYGELGPGTTGASSSGAGLHWGGPTQSSAYGKLYRGPTRVPPRGGRGRGVPY

SEQ ID NO: 155 - protein, 1120 aa, Artificial Sequence
  Synthetic Construct
MVLNSLDKMIQLQKNTANIRNICVLAHVDHGKTTLADCLISSNGIISSRLAGKLRYMDSREDEQIRGITMKSSAISLHYATGNEEYLINLIDSPGHVDFSSEVSTAVRICDGCIIVVDAVEGVCPQTQAVLRQAWLENIRPVLVINKIDRLIVELKFTPQEAYSHLKNILEQINALTGTLFTSKVLEERAERETESQVNPNSEQGEQVYDWSTGLEDTDDSHLYFSPEQGNVVFTSAIDGWGFGIEHFARIYSQKIGIKKEVLMKTLWGDYYINMKAKKIMKGDQAKGKKPLFVQLILENIWSLYDAVLKKDKDKIDKIVTSLGLKIGAREARHSDPKVQINAICSQWLPISHAVLAMVCQKLPSPLDITAERVERLMCTGSQTFDSFPPETQALKAAFMKCGSEDTAPVIIFVSKMFAVDAKALPQNKPRPLTQEEIAQRRERARQRHAEKLAAAQGQAPLEPTQDGSAIETCPKGEEPRGDEQQVESMTPKPVLQEENNQESFIAFARVFSGVARRGKKIFVLGPKYSPLEFLRRVPLGFSAPPDGLPQVPHMAYCALENLYLLMGRELEYLEEVPPGNVLGIGGLQDFVLKSATLCSLPSCPPFIPLNFEATPIVRVAVEPKHPSEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFEEQGASDLAKEGQEENETCSGGNENQELQDGCSEAFEKRTSQKGESPLTDCYGPFSGQLIATMKEACRYALQVKPQRLMAAMYTCDIMATGDVLGRVYAVLSKREGRVLQEEMKEGTDMFIIKAVLPVAESFGFADEIRKRTSGLASPQLVFSHWEIIPSDPFWVPTTEEEYLHFGEKADSENQARKYMNAVRKRKGLYVEEKIVEHAEKQRTLSKNK

SEQ ID NO: 156 - protein, 2015 aa, Artificial Sequence
  Synthetic Construct
MAGMSQRPPSMYWCVGPEESAVCPERAMETLNGAGDTGGKPSTRGGDPAARSRRTEGIRAAYRRGDRGGARDLLEEACDQCASQLEKGQLLSIPAAYGDLEMVRYLLSKRLVELPTEPTDDNPAVVAAYFGHTAVVQELLESLPGPCSPQRLLNWMLALACQRGHLGVVKLLVLTHGADPESYAVRKNEFPVIVRLPLYAAIKSGNEDIAIFLLRHGAYFCSYILLDSPDPSKHLLRKYFIEASPLPSSYPGKTALRVKWSHLRLPWVDLDWLIDISCQITELDLSANCLATLPSVIPWGLINLRKLNLSDNHLGELPGVQSSDEIICSRLLEIDISSNKLSHLPPGFLHLSKLQKLTASKNCLEKLFEEENATNWIGLRKLQELDISDNKLTELPALFLHSFKSLNSLNVSRNNLKVFPDPWACPLKCCKASRNALECLPDKMAVFWKNHLKDVDFSENALKEVPLGLFQLDALMFLRLQGNQLAALPPQEKWTCRQLKTLDLSRNQLGKNEDGLKTKRIAFFTTRGRQRSGTEAASVLEFPAFLSESLEVLCLNDNHLDTVPPSVCLLKSLSELYLGNNPGLRELPPELGQLGNLWQLDTEDLTISNVPAEIQKEGPKAMLSYLRAQLRKAEKCKLMKMIIVGPPRQGKSTLLEILQTGRAPQVVHGEATIRTTKWELQRPAGSRAKVESVEFNVWDIGGPASMATVNQCFFTDKALYVVVWNLALGEEAVANLQFWLLNIEAKAPNAVVLVVGTHLDLIEAKFRVERIATLRAYVLALCRSPSGSRATGFPDITFKHLHEISCKSLEGQEGLRQLIFHVTCSMKDVGSTIGCQRLAGRLIPRSYLSLQEAVLAEQQRRSRDDDVQYLTDRQLEQLVEQTPDNDIKDYEDLQSAISFLIETGTLLHFPDTSHGLRNLYFLDPIWLSECLQRIFNIKGSRSVAKNGVIRAEDLRMLLVGTGFTQQTEEQYFQFLAKFEIALPVANDSYLLPHLLPSKPGLDTHGMRHPTANTIQRVFKMSFVPVGFWQRFIARMLISLAEMDLQLFENKKNTKSRNRKVTIYSFTGNQRNRCSTFRVKRNQTIYWQEGLLVTFDGGYLSVESSDVNWKKKKSGGMKIVCQSEVRDFSAMAFITDHVNSLIDQWFPALTATESDGTPLMEQYVPCPVCETAWAQHTDPSEKSEDVQYFDMEDCVLTAIERDFISCPRHPDLPVPLQELVPELFMTDFPARLFLENSKLEHSEDEGSVLGQGGSGTVIYRARYQGQPVAVKRFHIKKFKNFANVPADTMLRHLRATDAMKNFSEFRQEASMLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSGAQRGRVIAVLKARELTPHGVLVDAAVVAKDTVVCTFENENTEWCLAVWRGWGAREFDIFYQSYEELGRLEACTRKRR

SEQ ID NO: 157 - protein, 420 aa, Artificial Sequence
  Synthetic Construct
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGISQSRISHWLLQQGSDLSEQKKRAFYRWYQLEKTNPGATLSMRPAPIPIEDPEWRQTPPPVSATSGTFRLRRGSRFTWRKECLAVMESYFNENQYPDEAKREEIANACNAVIQKPGKKLSDLERVTSLKVYNWFANRRKEIKRRANIEAAILESHGIDVQSPGGHSNSDDVDGNDYSEQDDSTSHSDHQDPISLAVEMAAVNHTILALARQGANEIKTEALDDD

SEQ ID NO: 158 - protein, 480 aa, Artificial Sequence
  Synthetic Construct
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 159 - protein, 926 aa, Artificial Sequence
  Synthetic Construct
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKGLGFSIAGGVGNQHIPGDNSIYVTKIIEGGAAHKDGKLQIGDKLLAVNNVCLEEVTHEEAVTALKNTSDFVYLKVAKPTSMYMNDGYAPPDITNSSSQPVDNHVSPSSFLGQTPASPARYSPVSKAVLGDDEITREPRKVVLHRGSTGLGFNIVGGEDGEGIFISFILAGGPADLSGELRKGDRIISVNSVDLRAASHEQAAAALKNAGQAVTIVAQYRPEEYSRFEAKIHDLREQMMNSSISSGSGSLRTSQKRSLYVRALFDYDKTKDSGLPSQGLNFKFGDILHVINASDDEWWQARQVTPDGESDEVGVIPSKRRVEKKERARLKTVKFNSKTRDKGQSFNDKRKKNLFSRKFPFYKNKDQSEQETSDADQHVTSNASDSESSYRGQEEYVLSYEPVNQQEVNYTRPVIILGPMKDRINDDLISEFPDKFGSCVPHTTRPKRDYEVDGRDYHFVTSREQMEKDIQEHKFIEAGQYNNHLYGTSVQSVREVAEKGKHCILDVSGNAIKRLQIAQLYPISIFIKPKSMENIMEMNKRLTEEQARKTFERAMKLEQEFTEHFTAIVQGDTLEDIYNQVKQIIEEQSGSYIWVPAKEKL

SEQ ID NO: 160 - protein, 333 aa, Artificial Sequence
  Synthetic Construct
MAAGCCGVKKQKLSSSPPSGSGGGGGASSSSHCSGESQCRAGELGLGGAGTRLNGLGGLTGGGSGSGCTLSPPQGCGGGGGGIALSPPPSCGVGTLLSTPAAATSSSPSSSSAASSSSPGSRKMVVSAEMCCFCFDVLYCHLYGYQQPRTPRFTNEPYPLFVTWKIGRDKRLRGCIGTFSAMNLHSGLREYTLTSALKDSRFPPMTRDELPRLFCSVSLLTNFEDVCDYLDWEVGVHGIRIEFINEKGSKRTATYLPEVAKEQGWDHIQTIDSLLRKGGYKAPITNEFRKTIKLTRYRSEKMTLSYAEYLAHRQHHHFQNGIGHPLPPYNHYS

SEQ ID NO: 161 - protein, 1962 aa, Artificial Sequence
  Synthetic Construct
MRELEAKATKDVERNLSRDLVQEEEQLMEEKKKKKDDKKKKEAAQKKATEQKIKVPEQIKPSVSQPQPANSNNGTSTATSTNNNAKRATANNQQPQQQQQQQQPQQQQPQQQPQPQPQQQQPQQQPQALPRYPREVPPRFRHQEHKQLLKRGQHFPVIAANLGSAVKVLNSQSESSALTNQQPQNNGEVQNSKNQSDINHSTSGSHYENSQRGPVSSTSDSSTNCKNAVVSDLSEKEAWPSAPGSDPELASECMDADSASSSESERNITIMASGNTGGEKDGLRNSTGLGSQNKFVVGSSSNNVGHGSSTGPWGFSHGAIISTCQVSVDAPESKSESSNNRMNAWGTVSSSSNGGLNPSTLNSASNHGAWPVLENNGLALKGPVGSGSSGINIQCSTIGQMPNNQSINSKVSGGSTHGTWGSLQETCESEVSGTQKVSFSGQPQNITTEMTGPNNTTNFMTSSLPNSGSVQNNELPSSNTGAWRVSTMNHPQMQAPSGMNGTSLSHLSNGESKSGGSYGTTWGAYGSNYSGDKCSGPNGQANGDTVNATLMQPGVNGPMGTNFQVNTNKGGGVWESGAANSQSTSWGSGNGANSGGSRRGWGTPAQNTGTNLPSVEWNKLPSNQHSNDSANGNGKTFTNGWKSTEEEDQGSATSQTNEQSSVWAKTGGTVESDGSTESTGRLEEKGTGESQSRDRRKIDQHTLLQSIVNRTDLDPRVLSNSGWGQTPIKQNTAWDTETSPRGERKTDNGTEAWGSSATQTFNSGACIDKTSPNGNDTSSVSGWGDPKPALRWGDSKGSNCQGGWEDDSAATGMVKSNQWGNCKEEKAAWNDSQKNKQGWGDGQKSSQGWSVSASDNWGETSRNNHWGEANKKSSSGGSDSDRSVSGWNELGKTSSFTWGNNINPNNSSGWDESSKPTPSQGWGDPPKSNQSLGWGDSSKPVSSPDWNKQQDIVGSWGIPPATGKPPGTGWLGGPIPAPAKEEEPTGWEEPSPESIRRKMEIDDGTSAWGDPSKYNYKNVNMWNKNVPNGNSRSDQQAQVHQLLTPASAISNKEASSGSGWGEPWGEPSTPATTVDNGTSAWGKPIDSGPSWGEPIAAASSTSTWGSSSVGPQALSKSGPKSMQDGWCGDDMPLPGNRPTGWEEEEDVEIGMWNSNSSQELNSSLNWPPYTKKMSSKGLSGKKRRRERGMMKGGNKQEEAWINPFVKQFSNISFSRDSPEENVQSNKMDLSGGMLQDKRMEIDKHSLNIGDYNRTVGKGPGSRPQISKESSMERNPYFDKDGIVADESQNMQFMSSQSMKLPPSNSALPNQALGSIAGLGMQNLNSVRQNGNPSMFGVGNTAAQPRGMQQPPAQPLSSSQPNLRAQVPPPLLSPQVPVSLLKYAPNNGGLNPLFGPQQVAMLNQLSQLNQLSQISQLQRLLAQQQRAQSQRSVPSGNRPQQDQQGRPLSVQQQMMQQSRQLDPNLLVKQQTPPSQQQPLHQPAMKSFLDNVMPHTTPELQKGPSPINAFSNFPIGLNSNLNVNMDMNSIKEPQSRLRKWTTVDSISVNTSLDQNSSKHGAISSGFRLEESPFVPYDFMNSSTSPASPPGSIGDGWPRAKSPNGSSSVNWPPEFRPGEPWKGYPNIDPETDPYVTPGSVINNLSINTVREVDHLRDRNSGSSSSLNTTLPSTSAWSSIRASNYNVPLSSTAQSTSARNSDSKLTWSPGSVTNTSLAHELWKVPLPPKNITAPSRPPPGLTGQKPPLSTWDNSPLRIGGGWGNSDARYTPGSSWGESSSGRITNWLVLKNLTPQIDGSTLRTLCMQHGPLITFHLNLPHGNALVRYSSKEEVVKAQKSLHMCVLGNTTILAEFASEEEISRFFAQSQSLTPSPGWQSLGSSQSRLGSLDCSHSFSSRTDLNHWNGAGLSGTNCGDLHGTSLWGTPHYSTSLWGPPSSSDPRGISSPSPINAFLSVDHLGGGGESM

SEQ ID NO: 162 - protein, 1657 aa, Artificial Sequence
  Synthetic Construct
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNTFSALANIDLALEQGDALALFRALQSPALGLRGLQQQNSDWYLKQLLSDKQQKRQSGQTDPLQKEELQSGVDAANSAAQQYQRRLAAVALINAAIQKGVAEKTVLELMNPEAQLPQVYPFAADLYQKELATLQRQSPEHNLTHPELSVAVEMLSSVALINRALESGDVNTVWKQLSSSVTGLTNIEEENCQRYLDELMKLKAQAHAENNEFITWNDIQACVDHVNLVVQEEHERILAIGLINEALDEGDAQKTLQALQIPAAKLEGVLAEVAQHYQDTLIRAKREKAQEIQDESAVLWLDEIQGGIWQSNKDTQEAQKFALGIFAINEAVESGDVGKTLSALRSPDVGLYGVIPECGETYHSDLAEAKKKKLAVGDNNSKWVKHWVKGGYYYYHNLETQEGGWDEPPNFVQNSMQLSREEIQSSISGVTAAYNREQLWLANEGLITRLQARCRGYLVRQEFRSRMNFLKKQIPAITCIQSQWRGYKQKKAYQDRLAYLRSHKDEVVKIQSLARMHQARKRYRDRLQYFRDHINDIIKIQAFIRANKARDDYKTLINAEDPPMVVVRKFVHLLDQSDQDFQEELDLMKMREEVITLIRSNQQLENDLNLMDIKIGLLVKNKITLQDVVSHSKKLTKKNKEQLSDMMMINKQKGGLKALSKEKREKLEAYQHLFYLLQTNPTYLAKLIFQMPQNKSTKFMDSVIFTLYNYASNQREEYLLLRLFKTALQEEIKSKVDQIQEIVTGNPTVIKMVVSFNRGARGQNALRQILAPVVKEIMDDKSLNIKTDPVDIYKSWVNQMESQTGEASKLPYDVTPEQALAHEEVKTRLDSSIRNMRAVTDKFLSAIVSSVDKIPYGMRFIAKVLKDSLHEKFPDAGEDELLKIIGNLLYYRYMNPAIVAPDAFDIIDLSAGGQLTTDQRRNLGSIAKMLQHAASNKMFLGDNAHLSIINEYLSQSYQKFRRFFQTACDVPELQDKFNVDEYSDLVTLTKPVIYISIGEIINTHTLLLDHQDAIAPEHNDPIHELLDDLGEVPTIESLIGESSGNLNDPNKEALAKTEVSLTLTNKFDVPGDENAEMDARTILLNTKRLIVDVIRFQPGETLTEILETPATSEQEAEHQRAMQRRAIRDAKTPDKMKKSKSVKEDSNLTLQEKKEKIQTGLKKLTELGTVDPKNKYQELINDIARDIRNQRRYRQRRKAELVKLQQTYAALNSKATFYGEQVDYYKSYIKTCLDNLASKGKVSKKPREMKGKKSKKISLKYTAARLHEKGVLLEIEDLQVNQFKNVIFEISPTEEVGDFEVKAKFMGVQMETFMLHYQDLLQLQYEGVAVMKLFDRAKVNVNLLIFLLNKKFYGK

SEQ ID NO: 163 - protein, 468 aa, Artificial Sequence
  Synthetic Construct
MMYFVIAAMKAQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 164 - protein, 352 aa, Artificial Sequence
  Synthetic Construct
MKPALLEVMRMNRICRMVLATCLGSFILVIFYFQSMLHPVMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 165 - protein, 150 aa, Artificial Sequence
  Synthetic Construct
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSAVAVVASLPVEVTSL

SEQ ID NO: 166 - protein, 1268 aa, Artificial Sequence
  Synthetic Construct
MDQKILSLAAEKTADKLQEFLQTLREGDLTNLLQNQAVKGKVAGALLRAIFKGSPCSEEAGTLRRRKIYTCCIQLVESGDLQKEIASEIIGLLMLEAHHFPGPLLVELANEFISAVREGSLVNGKSLELLPIILTALATKKENLAYGKGVLSGEECKKQLINTLCSGRWDQQYVIQLTSMFKDVPLTAEEVEFVVEKALSMFSKMNLQEIPPLVYQLLVLSSKGSRKSVLEGIIAFFSALDKQHNEEQSGDELLDVVTVPSGELRHVEGTIILHIVFAIKLDYELGRELVKHLKVGQQGDSNNNLSPFSIALLLSVTRIQRFQDQVLDLLKTSVVKSFKDLQLLQGSKFLQNLVPHRSYVSTMILEVVKNSVHSWDHVTQGLVELGFILMDSYGPKKVLDGKTIETSPSLSRMPNQHACKLGANILLETFKIHEMIRQEILEQVLNRVVTRASSPISHFLDLLSNIVMYAPLVLQSCSSKVTEAFDYLSFLPLQTVQRLLKAVQPLLKVSMSMRDCLILVLRKAMFANQLDARKSAVAGFLLLLKNFKVLGSLSSSQCSQSLSVSQVHVDVHSHYNSVANETFCLEIMDSLRRCLSQQADVRLMLYEGFYDVLRRNSQLANSVMQTLLSQLKQFYEPKPDLLPPLKLEACILTQGDKISLQEPLDYLLCCIQHCLAWYKNTVIPLQQGEEEEEEEEAFYEDLDDILESITNRMIKSELEDFELDKSADFSQSTSIGIKNNICAFLVMGVCEVLIEYNFSISSFSKNRFEDILSLFMCYKKLSDILNEKAGKAKTKMANKTSDSLLSMKFVSSLLTALFRVLLWRYTSIPTSVEESGKKEKGKSISLLCLEGLQKIFSAVQQFYQPKIQQFLRALDVTDKEGEEREDADVSVTQRTAFQIRQFQRSLLNLLSSQEEDFNSKEALLLVTVLTSLSKLLEPSSPQFVQMLSWTSKICKENSREDALFCKSLMNLLFSLHVSYKSPVILLRDLSQDIHGHLGDIDQDVEVEKTNHFAIVNLRTAAPTVCLLVLSQAEKVLEEVDWLITKLKGQVSQETLSEEASSQATLPNQPVEKAIIMQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 167 - protein, 531 aa, Artificial Sequence
  Synthetic Construct
MSKPHSEAGTAFIQTQQLHAAMADTFLEHMCRLDIDSPPITARNTGIICTIGPASRSVETLKEMIKSGMNVARLNFSHGTHEYHAETIKNVRTATESFASDPILYRPVAVALDTKGPEIRTGLIKGSGTAEVELKKGATLKITLDNAYMEKCDENILWLDYKNICKVVEVGSKIYVDDGLISLQVKQKGADFLVTEVENGGSLGSKKGVNLPGAAVDLPAVSEKDIQDLKFGVEQDVDMVFASFIRKASDVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEATAVGAVEASFKCCSGAIIVLTKSGRSAHQVARYRPRAPIIAVTRNPQTARQAHLYRGIFPVLCKDPVQEAWAEDVDLRVNFAMNVGKARGFFKKGDVVIVLTGWRPGSGFTNTMRVVPVP

SEQ ID NO: 168 - DNA, 1881 bp, Artificial Sequence
  Synthetic Construct
atggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagaggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 169 - DNA, 2709 bp, Artificial Sequence
  Synthetic Construct
atggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtgtgaaatgcctcagctcgtaaaaggaatgaaactgttaaaccaggctgatccctgtgtccagattttaattcaggaaacgggagagcacgttttagtcacagcaggagaagtccaccttcagcgatgcctggatgacttaaaagaaaggtttgcaaagattcatatcagtgtatctgaacctattattccattcagagaaacaatcacaaaacccccaaaagttgacatggtcaatgaagaaataggcaaacagcaaaaagttgcagtcatacaccaaatgaaagaagatcaaagcaaaatccctgaaggaatccaagttgactctgacgggctaatcaccataacaactcccaataaacttgccacgctcagtgttcgagccatgccccttccagaagaagtcacccagattctggaagaaaatagtgatttgattcgttctatggagcagttgacatcctctttgaatgagggtgaaaatactcacatgattcatcagaagacccaagagaaaatttgggaattcaaaggaaaactggagcaacacctaacagggagaagatggaggaacattgttgaccaaatctggtcatttggcccaagaaaatgtgggcccaacatactagtcaataaaagtgaagattttcagaactcagtatggacaggtccagctgacaaagcttcaaaagaagccagtagataccgagatttgggcaatagcattgtgagtggcttccaactagcaaccctctctggccccatgtgtgaggagcctctcatgggtgtctgttttgttctggaaaaatgggacctaagtaaatttgaggaacaaggagcaagtgatctggcaaaagagggacaggaggaaaatgaaacctgttctggtggaaatgaaaaccaagagctacaagatggctgctctgaggcctttgagaagaggacatcacagaaaggagaatctccactcactgactgctatggacctttctcaggacagctaattgccaccatgaaagaagcatgtcgctatgcactgcaagtgaaacctcagcgcctgatggcagctatgtacacatgtgacatcatggccactggtgatgttctcggtcgagtctatgctgtcttgtcaaagagagaaggtcgggtacttcaagaagaaatgaaagaagggacagacatgttcatcatcaaggctgtgctgcctgttgctgaaagctttggttttgctgatgaaatcaggaagaggacaagtggcctggccagcccacaactagtattcagccattgggagatcattcccagtgaccccttctgggtgccaactactgaggaggaatacttgcactttggggagaaggctgactctgagaaccaagcccggaagtacatgaacgcagtacgaaagcggaaggggctttatgtggaagaaaagattgtggagcatgcagaaaagcagaggacactcagcaaaaataagtag

SEQ ID NO: 170 - DNA, 3480 bp, Artificial Sequence
  Synthetic Construct
atggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatatctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctggcgcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaa

SEQ ID NO: 171 - DNA, 1668 bp, Artificial Sequence
  Synthetic Construct
atgcttagttcctttccagtggttttgctggaaaccatgtctcattatacagatgaacccagatttaccatagagcagatagatctgcttcagcgacttcggcgtactggaatgactaaacatgaaattctccatgccttggaaactttggaccgtcttgatcaagagcatagtgacaagtttggaagaaggtccagctatggaggaagttcatatgggaatagtactaacaatgtcccagcatcttcctctacagctacagcttccacacagacgcagcattcgggaatgtccccgtcacctagcaacagttatgatacttccccacagccttgcactaccaatcaaaatgggagggagaataatgagcgattatctacatccaatggaaagatgtcaccaactcgctaccatgcaaacagcatgggtcagaggtcatacagttttgaagcctcagaagaggacctagatgtagatgataaagtggaagaattaatgaggagggacagcagtgtgataaaagaggaaatcaaagcctttcttgccaatcggaggatttcccaagcagttgttgcacaggtaacaggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 172 - DNA, 2364 bp, Artificial Sequence
  Synthetic Construct
atggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 173 - DNA, 2256 bp, Artificial Sequence
  Synthetic Construct
atgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 174 - DNA, 2667 bp, Artificial Sequence
  Synthetic Construct
atggcggcgggttgctgcggggtgaagaagcagaaactgtccagttcgcccccctctggctcgggtggcggtggtggcgcctcctcctcctcccactgcagcggagagagccagtgccgagctggggagctgggactaggaggcgccggtacgcggctcaacgggctgggaggtctaaccggaggaggtagcggcagcggctgtaccctctctcccccccagggctgcggcggcggcggcggggggatcgccctgtcgccacctccgagctgcggagtggggaccctactttctaccccggccgccgccacctcttcctcaccctcctcatcgtccgccgcctcgtcctcatcgccgggctcccggaagatggtggtgtcagcagagatgtgctgcttttgcttcgatgtgctctactgtcacctgtatggataccagcagccccggaccccccgattcaccaacgagccctacccactgtttgtaacatggaagattggtcgagacaaaagattacgtggatgcataggtactttttctgccatgaatttgcattcaggactcagggagtacacacttaccagaaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 175 - DNA, 1056 bp, Artificial Sequence
  Synthetic Construct
atgagagaattggaagctaaagctaccaaagacgtagaaagaaatcttagcagggatttagtgcaagaagaagaacagttgatggaagaaaagaaaaagaaaaaagacgacaagaaaaagaaggaagctgctcaaaagaaggccactgaacaaaaaatcaaagatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 176 - DNA, 2187 bp, Artificial Sequence
  Synthetic Construct
atgtccgccgcagacgaggttgacgggctgggcgtggcccggccgcactatggctctgtcctggataatgaaagacttactgcagaggagatggatgaaaggagacgtcagaacgtggcttatgagtacctttgtcatttggaagaagcgaagaggtggatggaagcatgcctaggggaagatctgcctcccaccacagaactggaggaggggcttaggaatggggtctaccttgccaaactggggaacttcttctctcccaaagtagtgtccctgaaaaaaatctatgatcgagaacagaccagatacaaggcgactggcctccactttagacacactgataatgtgattcagtggttgaatgccatggatgagattggattgcctaagattttttacccagaaactacagatatctatgatcgaaagaacatgccaagatgtatctactgtatccatgcactcagtttgtacctgttcaagctaggcctggcccctcagattcaagacctatatggaaaggttgacttcacagaagaagaaatcaacaacatgaagactgagttggagaagtatggcatccagatgcctgcctttagcaagattgggggcatcttggctaatgaactgtcagtggatgaagccgcattacatgctgctgttattgctattaatgaagctattgaccgtagaattccagccgacacatttgcagctttgaaaaatccgaatgccatgcttgtaaatcttgaagagcccttggcatccacttaccaggatatactttaccaggctaagcaggacaaaatgacaaatgctaaaaacaggacagaaaactcagagagagaaagagatgtttatgaggagctgctcacgcaagctgaaattcaaggcaatataaacaaagtcaataagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 177 - protein, 626 aa, Artificial Sequence
  Synthetic Construct
MAAVPQNNLQEQLERHSARTLNNKLSLSKPKFSGFTFKKKTSSDNNVSVTNVSVAKTPVLRNKDVNVTEDFSFSEPLPNTTNQQRVKDFFKNAPAGQETQRGGSKSLLPDFLQTPKEVVCTTQNTPTVKKSRDTALKKLEFSSSPDSLSTINDWDDMDDFDTSETSKSFVTPPQSHFVRVSTAQKSKKGKRNFFKAQLYTTNTVKTDLPPPSSESEQIDLTEEQKDDSEWLSSDVICIDDGPIAEVHINEDAQESDSLKTHLEDERGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 178 - protein, 902 aa, Artificial Sequence
  Synthetic Construct
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILCEMPQLVKGMKLLNQADPCVQILIQETGEHVLVTAGEVHLQRCLDDLKERFAKIHISVSEPIIPFRETITKPPKVDMVNEEIGKQQKVAVIHQMKEDQSKIPEGIQVDSDGLITITTPNKLATLSVRAMPLPEEVTQILEENSDLIRSMEQLTSSLNEGENTHMIHQKTQEKIWEFKGKLEQHLTGRRWRNIVDQIWSFGPRKCGPNILVNKSEDFQNSVWTGPADKASKEASRYRDLGNSIVSGFQLATLSGPMCEEPLMGVCFVLEKWDLSKFEEQGASDLAKEGQEENETCSGGNENQELQDGCSEAFEKRTSQKGESPLTDCYGPFSGQLIATMKEACRYALQVKPQRLMAAMYTCDIMATGDVLGRVYAVLSKREGRVLQEEMKEGTDMFIIKAVLPVAESFGFADEIRKRTSGLASPQLVFSHWEIIPSDPFWVPTTEEEYLHFGEKADSENQARKYMNAVRKRKGLYVEEKIVEHAEKQRTLSKNK

SEQ ID NO: 179 - protein, 1159 aa, Artificial Sequence
  Synthetic Construct
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYIYLLPHLLPSKPGLDTHGMRHPTANTIQRVFKMSFVPVGFWQRFIARMLISLAEMDLQLFENKKNTKSRNRKVTIYSFTGNQRNRCSTFRVKRNQTIYWQEGLLVTFDGGYLSVESSDVNWKKKKSGGMKIVCQSEVRDFSAMAFITDHVNSLIDQWFPALTATESDGTPLMEQYVPCPVCETAWAQHTDPSEKSEDVQYFDMEDCVLTAIERDFISCPRHPDLPVPLQELVPELFMTDFPARLFLENSKLEHSEDEGSVLGQGGSGTVIYRARYQGQPVAVKRFHIKKFKNFANVPADTMLRHLRATDAMKNFSEFRQEASMLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSGAQRGRVIAVLKARELTPHGVLVDAAVVAKDTVVCTFENENTEWCLAVWRGWGAREFDIFYQSYEELGRLEACTRKRR

SEQ ID NO: 180 - protein, 555 aa, Artificial Sequence
  Synthetic Construct
MLSSFPVVLLETMSHYTDEPRFTIEQIDLLQRLRRTGMTKHEILHALETLDRLDQEHSDKFGRRSSYGGSSYGNSTNNVPASSSTATASTQTQHSGMSPSPSNSYDTSPQPCTTNQNGRENNERLSTSNGKMSPTRYHANSMGQRSYSFEASEEDLDVDDKVEELMRRDSSVIKEEIKAFLANRRISQAVVAQVTGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 181 - protein, 787 aa, Artificial Sequence
  Synthetic Construct
MASDSIFESFPSYPQCFMRECILGMNPSRDVHDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 182 - protein, 751 aa, Artificial Sequence
  Synthetic Construct
MPVRKQDTQRALHLLEEYRSKLSQTEDRQLRSSIERVINIFQSNLFQALIDIQEFYEVTLLDNPKCIDRSKPSEPIQPVNTWEISSLPSSTVTSETLPSSLSPSVEKYRYQDEDTPPQEHISPQITNEVIGPELVHVSEKNLSEIENVHGFVSHSHISPIKPTEAVLPSPPTVPVIPVLPVPAENTVILPTIPQANPPPVLVNTDSLETPTYVNGTDADYEYEEITLERGNSGLGFSIAGGTDNPHIGDDSSIFITKIITGGAAAQDGRLRVNDCILRVNEVDVRDVTHSKAVEALKEAGSIVRLYVKRRKPVSEKIMEIKLIKGPKESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 183 - protein, 888 aa, Artificial Sequence
  Synthetic Construct
MAAGCCGVKKQKLSSSPPSGSGGGGGASSSSHCSGESQCRAGELGLGGAGTRLNGLGGLTGGGSGSGCTLSPPQGCGGGGGGIALSPPPSCGVGTLLSTPAAATSSSPSSSSAASSSSPGSRKMVVSAEMCCFCFDVLYCHLYGYQQPRTPRFTNEPYPLFVTWKIGRDKRLRGCIGTFSAMNLHSGLREYTLTRNLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 184 - protein, 351 aa, Artificial Sequence
  Synthetic Construct
MRELEAKATKDVERNLSRDLVQEEEQLMEEKKKKKDDKKKKEAAQKKATEQKIKDVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 185 - protein, 728 aa, Artificial Sequence
  Synthetic Construct
MSAADEVDGLGVARPHYGSVLDNERLTAEEMDERRRQNVAYEYLCHLEEAKRWMEACLGEDLPPTTELEEGLRNGVYLAKLGNFFSPKVVSLKKIYDREQTRYKATGLHFRHTDNVIQWLNAMDEIGLPKIFYPETTDIYDRKNMPRCIYCIHALSLYLFKLGLAPQIQDLYGKVDFTEEEINNMKTELEKYGIQMPAFSKIGGILANELSVDEAALHAAVIAINEAIDRRIPADTFAALKNPNAMLVNLEEPLASTYQDILYQAKQDKMTNAKNRTENSERERDVYEELLTQAEIQGNINKVNKSTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 186 - DNA, 2391 bp, Artificial Sequence
  Synthetic Construct
atgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 187 - DNA, 2283 bp, Artificial Sequence
  Synthetic Construct
atgaaggaggccgccctcatctgcctggcaccctctgtacccccgatcttgacggtgaagtcctgggacaccatgcagttgcgggctgctagatctcggtgcacaaacttgttggcagcaagctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 188 - protein, 796 aa, Artificial Sequence; identical to SEQ ID NO: 4
  Synthetic Construct

SEQ ID NO: 189 - protein, 760 aa, Artificial Sequence
  Synthetic Construct
MKEAALICLAPSVPPILTVKSWDTMQLRAARSRCTNLLAASYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 190 - DNA, 2517 bp, Artificial Sequence
  Synthetic Construct
atgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 191 - protein, 838 aa, Artificial Sequence
  Synthetic Construct
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 192 - DNA, 2478 bp, Artificial Sequence
  Synthetic Construct
atggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 193 - protein, 825 aa, Artificial Sequence; identical to SEQ ID NO: 10
  Synthetic Construct

SEQ ID NO: 194 - DNA, 9101 bp, Artificial Sequence
  Synthetic Construct
ggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattttaaaaaaaccctctagaatacacataataacataatgaaagccatatctccatgatatatatgtgcacatatatatacatacatgtgcatgtatgtatcatattaaggacccatggtactcttaaaacactgtagaactctgtgacgcagtaaggaaggggcagatttgtacaaaaacttttctagattccatcagcaaaaaccaacacaggtttgtcacgctgcatgtctggccagctaatctcgggggaaaagctacaagttatttattttattttaagagaataaagtaggtaataatttaagggatcaaattcaaggaggaatgtgcaattttagagcaaagatttgtttaaggcaaatgagactttgggagcatcccattccagttttgtcttttttttctctgaaagaaaaaagcaaaaaataaaataaaattccacttataccttctgacaagtccctaaaggtcttgaaataaaaggttctatgcaagtgcaaagttttatagttatttttattgctgattattactattactatctctgttgtcttaagagtatgtgctgatttcagagacatctcaaattgaaagaatatcagattgcttttaaagtagctgaacgagccacagaatatctgaaattattcattgttgttcctccaccaccccctttctcatggtctgatttttagaagagtggcatcctcgttctaaaatgtaatgatcaccaaatacggccttccatcaaatttgtgaaaactacaacagtataacagtgacaaacctaattctctagcccaaacctggtctgacaatcatttccatttagaagtcattgaatagttttccaaacactttccatgtgtgttagcaaattattcctattttgtgtagatgaggacgttgagactcagagacattcagaggcacgctagaggtctccagcctagcttccagcaccattgggactgaatccaagtactctcactctgaacttcgtggttctgtccactagagactctaatatgcaaacaagcagttcaggaaagaaagcatgctaacacattcatgaagcagtatatgaagttagaagaacaaaaggaaatacaggagatgacaagcaactgagatattgtgatatataatcatgctcttagcttcagctaaattcagctaaattcttgtacactgaaccaatgtcataatcaggcttatttagaaaacactttgaactatgctataaaagattatatcagaattcatattatacatgtgttcacatcagcgctacctgtgatgttttcatgtatttatgtatgtgttataaatacttgatttatacatatacaaatgcacatacgtagtgtgtttgtgtgtttatgtataaatttataggcacacaataatagaggtaattataagtaggatgcggtatgaataatttgcttaaaatatgctaaataaccaaaactgtttaacgtcatgttgctgttagtgcttccatactccacgtgggtaggactacatcacacttttcaactctgtgcagtactgcatgggtggaagacatatttaagataatgtgcttcccaaaacaactgaataaaagccatcccactacattgagtgctttctctggctccttgcaaagaaagatactttttgtaatggtccaggaaaggaacattgctttctttttgtctttcagcacatttgtattatgctcaccttgtctctgtctcactgtgacccctttacacttgagttcagagttcaagcattccaaatataaattggaatgttggcagcccagtggcttgaaggccaatgatgagcagtccaagaccccacagcgagatgagcaactcttaggaattcccacatcctagagtgaatgcaccaactaacagtatagaatgctgtccttttcaaagcgtcctaacagcaggattacctggtcaagtatggactttctttgaatctttcttttcacaaattggactgcctgtaataccaataacattgttgtatctaactaaataaatgactgcatatacacacataccctcaattctcttgcttccccattttctttttcatcccctgtctcaggacttttattttcaatgttgacctttggtttggccatatatcactgttataggaaatctcatgagaggaatggctagtgacccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaaaatatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgcttaaaaaatgtataaagcagctggaaatgttttaaatacaaggtctttgaattaaatgtggattttaaatatgtaatcccttgacaaatgaccaaattatggtgaactattgctccctgcgttctttgatcattacctatgacttacaaatctgcctggagatgtggacattctgcatttgcttctgtatctggagagatgtttgtatatatccaggccgtatacacacacatttccatatctctctacagatatatttccccttcaatcgtgacctggtatttggaactctccttttcatttggcttatcttccttttaatgtgatgtctctgtgctaatacttaccagttcttgttttgcaatctgttttgaggtccattgctttactaagacccactgcatcttggctgatttcaaagtgacacctgaatacagtgtttaaaaaaaaaaaagttttgtttgtaaatcatgtgaccagcttctctcaacctgacatggaaagtctcttgtactacagtgtatttaataaaaatgatgtcttacaataaataacatactccaaaa

SEQ ID NO: 195 - DNA, 3495 bp, Artificial Sequence
  Synthetic Construct
atgttttggaaatttgatcttcactcatcatcccacatagacacacttctagaaagagaagatgtaacactgaaggagttaatggatgaggaagatgttttacaggaatgtaaagctcagaaccgcaaacttatagagtttctgttaaaagcagaatgtctcgaagatttagtctcattcattatagaagaaccacctcaagacatggatgaaaagatcagatacaagtatccaaatatatcttgtgagttgctcacttctgatgtctcccagatgaatgatagactgggagaagatgaatccttgctaatgaaattatatagcttcctcctaaacgattcccctttgaatccactacttgccagtttcttcagcaaggtgctaagtattcttatcagcagaaaaccagaacagattgtggatttcttaaagaagaagcatgattttgtagaccttattataaagcacataggaacttctgctatcatggatttgttgctcaggctcctgacgtgtatcgaacctccacagcccaggcaagatgtgctgaattggttaaatgaggagaaaattatccagaggcttgtggaaatagttcatccatcgcaagaagaagatcgacattcaaatgcatcacaatcactttgtgaaattgttcgcctgagcagagaccagatgttacaaattcagaacagtacagagcccgaccccctgcttgccactctagaaaagcaagaaattatagagcagcttctatcaaatattttccacaaggagaaaaatgagtcagccatagtcagtgcaatccagatattgctgactttacttgagacacgacgaccaacatttgaaggccatatagagatctgcccaccaggcatgagccattcagcttgttcagtaaacaagagtgttctagaagccatcagaggaagacttggatcttttcatgaactcctgctggagccacccaagaacatgttcttcaagtatacatggaataactttttgcatacacaagtggaaatttgtattgcactgattcttgcaagtccttttgaaaacacagaaaatgccacaattaccgatcaagactccactggtgataatttgttattaaaacatcttttccaaaaatgtcaattaatagaacgaatacttgaagcctgggaaatgaatgagaagaaacatttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 196 - protein, 1164 aa, Artificial Sequence
  Synthetic Construct
MFWKFDLHSSSHIDTLLEREDVTLKELMDEEDVLQECKAQNRKLIEFLLKAECLEDLVSFIIEEPPQDMDEKIRYKYPNISCELLTSDVSQMNDRLGEDESLLMKLYSFLLNDSPLNPLLASFFSKVLSILISRKPEQIVDFLKKKHDFVDLIIKHIGTSAIMDLLLRLLTCIEPPQPRQDVLNWLNEEKIIQRLVEIVHPSQEEDRHSNASQSLCEIVRLSRDQMLQIQNSTEPDPLLATLEKQEIIEQLLSNIFHKEKNESAIVSAIQILLTLLETRRPTFEGHIEICPPGMSHSACSVNKSVLEAIRGRLGSFHELLLEPPKNMFFKYTWNNFLHTQVEICIALILASPFENTENATITDQDSTGDNLLLKHLFQKCQLIERILEAWEMNEKKHFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 197 - DNA, 5194 bp, Artificial Sequence
  Synthetic Construct
atggatgtctctctttgcccagccaagtgtagtttctggcggattttcttgctgggaagcgtctggctggactatgtgggctccgtgctggcttgccctgcaaattgtgtctgcagcaagactgagatcaattgccggcggccggacgatgggaacctcttccccctcctggaagggcaggattcagggaacagcaatgggaacgccagtatcaacatcacggacatctcaaggaatatcacttccatacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaatgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgttgcacagtgacttgtggccgagggttacggtaccgggttgttctgtgtattaaccaccgcggagagcatgttgggggctgcaatccacaactgaagttacacatcaaagaagaatgtgtcattcccatcccgtgttataaaccaaaagaaaaaagtccagtggaagcaaaattgccttggctgaaacaagcacaagaactagaagagaccagaatagcaacagaagaaccaacgttcattccagaaccctggtcagcctgcagtaccacgtgtgggccgggtgtgcaggtccgtgaggtgaagtgccgtgtgctcctcacattcacgcagactgagactgagctgcccgaggaagagtgtgaaggccccaagctgcccaccgaacggccctgcctcctggaagcatgtgatgagagcccggcctcccgagagctagacatccctctccctgaggacagtgagacgacttacgactgggagtacgctgggttcaccccttgcacagcaacatgcgtgggaggccatcaagaagccatagcagtgtgcttacatatccagacccagcagacagtcaatgacagcttgtgtgatatggtccaccgtcctccagccatgagccaggcctgtaacacagagccctgtccccccaggtggcatgtgggctcttgggggccctgctcagctacctgtggagttggaattcagacccgagatgtgtactgcctgcacccaggggagacccctgcccctcctgaggagtgccgagatgaaaagccccatgctttacaagcatgcaatcagtttgactgccctcctggctggcacattgaagaatggcagcagtgttccaggacttgtggcgggggaactcagaacagaagagtcacctgtcggcagctgctaacggatggcagctttttgaatctctcagatgaattgtgccaaggacccaaggcatcgtctcacaagtcctgtgccaggacagactgtcctccacatttagctgtgggagactggtcgaagtgttctgtcagttgtggtgttggaatccagagaagaaagcaggtgtgtcaaaggctggcagccaaaggtcggcgcatccccctcagtgagatgatgtgcagggatctaccagggctccctcttgtaagatcttgccagatgcctgagtgcagtaaaatcaaatcagagatgaagacaaaacttggtgagcagggtccgcagatcctcagtgtccagagagtctacattcagacaagggaagagaagcgtattaacctgaccattggtagcagagcctatttgctgcccaacacatccgtgattattaagtgccccgtgcgacgattccagaaatctctgatccagtgggagaaggatggccgttgcctgcagaactccaaacggcttggcatcaccaagtcaggctcactaaaaatccatggtcttgctgcccccgacatcggcgtgtaccggtgcattgcaggctctgcacaggaaacagttgtgctcaagctcattggtactgacaaccggctcatcgcacgcccagccctcagggagcctatgagggaatatcctgggatggaccacagcgaagccaatagtttgggagtcacatggcacaaaatgaggcaaatgtggaataacaaaaatgacctttatctggatgatgaccacattagtaaccagcctttcttgagagctctgttaggccactgcagcaattctgcaggaagcaccaactcctgggagttgaagaataagcagtttgaagcagcagttaaacaaggagcatatagcatggatacagcccagtttgatgagctgataagaaacatgagtcagctcatggaaaccggagaggtcagcgatgatcttgcgtcccagctgatatatcagctggtggccgaattagccaaggcacagccaacacacatgcagtggcggggcatccaggaagagacacctcctgctgctcagctcagaggggaaacagggagtgtgtcccaaagctcgcatgcaaaaaactcaggcaagctgacattcaagccgaaaggacctgttctcatgaggcaaagccaacctccctcaatttcatttaataaaacaataaattccaggattggaaatacagtatacattacaaaaaggacagaggtcatcaatatactgtgtgaccttattacccccagtgaggccacatatacatggaccaaggatggaaccttgttacagccctcagtaaaaataattttggatggaactgggaagatacagatacagaatcctacaaggaaagaacaaggcatatatgaatgttctgtagctaatcatcttggttcagatgtggaaagttcttctgtgctgtatgcagaggcacctgtcatcttgtctgttgaaagaaatatcaccaaaccagagcacaaccatctgtctgttgtggttggaggcatcgtggaggcagcccttggagcaaacgtgacaatccgatgtcctgtaaaaggtgtccctcagcctaatataacttggttgaagagaggaggatctctgagtggcaatgtttccttgcttttcaatggatccctgttgttgcagaatgtttcccttgaaaatgaaggaacctacgtctgcatagccaccaatgctcttggaaaggcagtggcaacatctgtactccacttgctggaacgaagatggccagagagtagaatcgtatttctgcaaggacataaaaagtacattctccaggcaaccaacactagaaccaacagcaatgacccaacaggagaacccccgcctcaagagcctttttgggagcctggtaactggtcacattgttctgccacctgtggtcatttgggagcccgcattcagagaccccagtgtgtgatggccaatgggcaggaagtgagtgaggccctgtgtgatcacctccagaagccactggctgggtttgagccctgtaacatccgggactgcccagcgaggtggttcacaagtgtgtggtcacagtgctctgtgtcttgcggtgaaggataccacagtcggcaggtgacgtgcaagcggacaaaagccaatggaactgtgcaggtggtgtctccaagagcatgtgcccctaaagaccggcctctgggaagaaaaccatgttttggtcatccatgtgttcagtgggaaccagggaaccggtgtcctggacgttgcatgggccgtgctgtgaggatgcagcagcgtcacacagcttgtcaacacaacagctctgactccaactgtgatgacagaaagagacccaccttaagaaggaactgcacatcaggggcctgtgatgtgtgttggcacacaggcccttggaagccctgtacagcagcctgtggcaggggtttccagtctcggaaagtcgactgtatccacacaaggagttgcaaacctgtggccaagagacactgtgtacagaaaaagaaaccaatttcctggcggcactgtcttgggccctcctgtgatagagactgcacagacacaactcactactgtatgtttgtaaaacatcttaatttgtgttctctagaccgctacaaacaaaggtgctgccagtcatgtcaagagggataa

SEQ ID NO: 198 - protein, 528 aa, Artificial Sequence
  Synthetic Construct
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDT

SEQ ID NO: 199 - protein, 1202 aa, Artificial Sequence
  Synthetic Construct
CTVTCGRGLRYRVVLCINHRGEHVGGCNPQLKLHIKEECVIPIPCYKPKEKSPVEAKLPWLKQAQELEETRIATEEPTFIPEPWSACSTTCGPGVQVREVKCRVLLTFTQTETELPEEECEGPKLPTERPCLLEACDESPASRELDIPLPEDSETTYDWEYAGFTPCTATCVGGHQEAIAVCLHIQTQQTVNDSLCDMVHRPPAMSQACNTEPCPPRWHVGSWGPCSATCGVGIQTRDVYCLHPGETPAPPEECRDEKPHALQACNQFDCPPGWHIEEWQQCSRTCGGGTQNRRVTCRQLLTDGSFLNLSDELCQGPKASSHKSCARTDCPPHLAVGDWSKCSVSCGVGIQRRKQVCQRLAAKGRRIPLSEMMCRDLPGLPLVRSCQMPECSKIKSEMKTKLGEQGPQILSVQRVYIQTREEKRINLTIGSRAYLLPNTSVIIKCPVRRFQKSLIQWEKDGRCLQNSKRLGITKSGSLKIHGLAAPDIGVYRCIAGSAQETVVLKLIGTDNRLIARPALREPMREYPGMDHSEANSLGVTWHKMRQMWNNKNDLYLDDDHISNQPFLRALLGHCSNSAGSTNSWELKNKQFEAAVKQGAYSMDTAQFDELIRNMSQLMETGEVSDDLASQLIYQLVAELAKAQPTHMQWRGIQEETPPAAQLRGETGSVSQSSHAKNSGKLTFKPKGPVLMRQSQPPSISFNKTINSRIGNTVYITKRTEVINILCDLITPSEATYTWTKDGTLLQPSVKIILDGTGKIQIQNPTRKEQGIYECSVANHLGSDVESSSVLYAEAPVILSVERNITKPEHNHLSVVVGGIVEAALGANVTIRCPVKGVPQPNITWLKRGGSLSGNVSLLFNGSLLLQNVSLENEGTYVCIATNALGKAVATSVLHLLERRWPESRIVFLQGHKKYILQATNTRTNSNDPTGEPPPQEPFWEPGNWSHCSATCGHLGARIQRPQCVMANGQEVSEALCDHLQKPLAGFEPCNIRDCPARWFTSVWSQCSVSCGEGYHSRQVTCKRTKANGTVQVVSPRACAPKDRPLGRKPCFGHPCVQWEPGNRCPGRCMGRAVRMQQRHTACQHNSSDSNCDDRKRPTLRRNCTSGACDVCWHTGPWKPCTAACGRGFQSRKVDCIHTRSCKPVAKRHCVQKKKPISWRHCLGPSCDRDCTDTTHYCMFVKHLNLCSLDRYKQRCCQSCQEG

SEQ ID NO: 200 - DNA, 1344 bp, Artificial Sequence
  Synthetic Construct
atggcggacgaggccccgcggaagggcagcttctcggcgctcgtgggccgcaccaacggcctcaccaagcccgcggccctggccgccgcgcccgccaagccggggggcgcgggcggctccaagaagctggtcatcaagaacttccgagacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 201 - protein, 447 aa, Artificial Sequence
  Synthetic Construct
MADEAPRKGSFSALVGRTNGLTKPAALAAAPAKPGGAGGSKKLVIKNFRDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 202 - DNA, 2319 bp, Artificial Sequence
  Synthetic Construct
atgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagcttcttttattgcagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgcccggctgtgctggctccagaggatgggctggccatgtccctgcatttcatgacattgggtggcagctccctgtcccccaccgagggcaaaggctctgggctccaaggccacatcatcgagaacccacaatacttcagtgatgcctgtgttcaccacatcaagcgccgggacatcgtgctcaagtgggagctgggggagggcgcctttgggaaggtcttccttgctgagtgccacaacctcctgcctgagcaggacaagatgctggtggctgtcaaggcactgaaggaggcgtccgagagtgctcggcaggacttccagcgtgaggctgagctgctcaccatgctgcagcaccagcacatcgtgcgcttcttcggcgtctgcaccgagggccgccccctgctcatggtctttgagtatatgcggcacggggacctcaaccgcttcctccgatcccatggacctgatgccaagctgctggctggtggggaggatgtggctccaggccccctgggtctggggcagctgctggccgtggctagccaggtcgctgcggggatggtgtacctggcgggtctgcattttgtgcaccgggacctggccacacgcaactgtctagtgggccagggactggtggtcaagattggtgattttggcatgagcagggatatctacagcaccgactattaccgtgtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggcaatcgactgcatcacgcagggacgtgagttggagcggccacgtgcctgcccaccagaggtctacgccatcatgcggggctgctggcagcgggagccccagcaacgccacagcatcaaggatgtgcacgcccggctgcaagccctggcccaggcacctcctgtctacctggatgtcctgggctag

SEQ ID NO: 203 - protein, 772 aa, Artificial Sequence
  Synthetic Construct
MPSKTKYNLVDDGHDLRIPLHNEDAFQHGICFEAKYVGSLDVPRPNSRVEIVAAMRRIRYEFKAKNIKKKKVSIMVSVDGVKVILKKKKKLLLLQKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAISFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 204 - DNA, 1593 bp, Artificial Sequence
  Synthetic Construct
atgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagagaacctgactgagctctacatcgagaaccagcagcatctgcagcatctggagctccgtgatctgaggggcctgggggagctgagaaacctcaccatcgtgaagagtggtctccgtttcgtggcgccagatgccttccatttcactcctcggctcagtcgcctgaatctctccttcaacgctctggagtctctctcctggaaaactgtgcagggcctctccttacaggaactggtcctgtcggggaaccctctgcactgttcttgtgccctgcgctggctacagcgctgggaggaggagggactgggcggagtgcctgaacagaagctgcagtgtcatgggcaagggcccctggcccacatgcccaatgccagctgtggtgtgcccacgctgaaggtccaggtgcccaatgcctcggtggatgtgggggacgacgtgctgctgcggtgccaggtggaggggcggggcctggagcaggccggctggatcctcacagagctggagcagtcagccacggtgatgaaatctgggggtctgccatccctggggctgaccctggccaatgtcaccagtgacctcaacaggaagaacgtgacgtgctgggcagagaacgatgtgggccgggcagaggtctctgttcaggtcaacgtctccttcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggctgccttcatggacaaccctttcgagttcaaccccgaggaccccatccctgtctccttctcgccggtggacactaacagcacatctggagacccggtggagaagaaggacgaaacaccttttggggtctcggtggctgtgggcctggccgtctttgcctgcctcttcctttctacgctgctccttgtgctcaacaaatgtggacggagaaacaagtttgggatcaaccgtgcgaagcccagcggtgcagagtccagcaaaggtgcagcctttgtgtccaagcaggagggcagcgaggtagtgaagagacccaggcgctacctgtatcaatggctgggagccccagtcccctacccggatcccctggagcccaggagggaggtgtgtgagctcaatccggactgtgacgagttggctgaccacatcggctttcaggaggcctatcggcgcttctacggcccggtctag

SEQ ID NO: 205 - protein, 530 aa, Artificial Sequence
  Synthetic Construct
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRAKPSGAESSKGAAFVSKQEGSEVVKRPRRYLYQWLGAPVPYPDPLEPRREVCELNPDCDELADHIGFQEAYRRFYGPV

SEQ ID NO: 206 - DNA, 6654 bp, Artificial Sequence
  Synthetic Construct
atgggtgtaaagaagaagaaagaaatgcaagttgctgcgctgaccatttgccatcaggaccttgaaactttgaaatcttttgctgatgtggaagggaaaaatctagcttctttgctgttacattgtgtgcaactcacggatggagtgtcacaaatccattatattaaacagattgtgcctctgctggagaaagcagataaaaatggcatgtgtgatcccactattcaaagttgtttggatatcttagcaggcatttatctttctttgagtctaaagaatcccttgaagaaagtattggcaagctcactaaatagcctgcctgatttttttctacctgaggctatgcaccgttttacttctcgtcttcaggaagaattgaatactactgacttatactcttacaggaaagttactgacaatatttcttcctgtatggagaactttaacttgggtagagcaagtgttaataatctgcttaaaaatgtgcttcattttctgcagaagagtttaattgaaatcctggaagaaaatagaaaatgtgctggaaatcatattattcaaacacagttgatgaatgacttactggtaggcattagagtttcaatgatgttagtacagaaagtacaagatttccagggaaatctttggaagacttccgattctcccatatggcaaaatatgtgtggattgctgagtatttttaccaaggttttaagcgatgatgatctgttacagactgtacagagcacatctggattagctattattctttttattaagactatgtttcacccgtctgaaaagattcctcatttgattagcagtgtgctgcttcgttcagtggactgcaccagtgtccccgagtggtttatgagcagctgcaggagcctctgttgtggtgacatctctcagtcagctgtcttattcctctgtcaggggacacttgccatgttggactggcagaacggaagcatgggtcggagtggggaggccctgctcttggatactgcacatgttttgttcaccttgagttcacagattaaagagccaacgctggaaatgtttctgtctagaatcttagcatcctggactaattcagccatacaagtccttgaatcaagttccccgagcctaacggacagcctgaatgggaattcaagtatagttgggagacttttggaatatgtctatacccattgggaacatccattggatgctctgagacaccaaaccaaaatcatgttcaaaaaccttctccaaatgcaccggctcactgtggaaggtgcagatttcgtccctgatcctttctttgtggaattgactgagagtcttttacgattggaatggcatattaaaggaaagtacacgtgccttggttgtttggtagagtgcataggagttgaacatattttggctatagataaaactattccatctcaaatcttagaggtgatgggagaccagtcattggtaccttatgcaagtgacctcttggaaaccatgtttagaaatcataagagtcatttgaaatcccagactgctgagagttcttggattgaccagtggcatgagacttgggtttctcctctcctttttatattgtgtgaaggaaacttggatcaaaaatcttacgtgattgattattacttgccaaaattattaagttacagccctgaaagcttacagtacatggtaaagattcttcagacttctattgatgctaaaactggacaagagcaatctttcccatccttagggtcttgtaatagcaggggggctctgggagctttgatggcatgtctgcgaatagctagagctcatggacatcttcagtctgcaactgatacctgggagaacctcgtgtctgatgcaagaataaagcaaggcttaattcatcagcattgccaagtaaggatagatacattaggcttgctttgtgaaagtaatcggagcacagaaattgtttccatggaagaaatgcagtggattcagttctttattacatacaatcttaacagccagtctccaggagtgcggcaacagatctgttctcttcttaaaaagttgttttgtaggatacaggaaagttctcaggtactttataaattggagcagagtaaatccaaacgtgaaccagagaatgagttaaccaaacagcacccttctgtttctttacagcagtataagaatttcatgtcatccatttgtaacagtctttttgaagcattgtttcctggatcttcctactcgactagattttcagctttaaccattttaggttcaatagctgaagtttttcatgtcccagaaggcagaatttatacagtatatcagctgagtcatgatattgatgttggtcgtttccaaacactaatggaatgttttaccagcacttttgaagacgtgaaaattttagcatttgatcttctgatgaagttatcaaaaacagctgtacattttcaggattcggggaaactgcaaggcttatttcaggcagcattggagctcagcacaagcaccaaaccatacgactgtgtgacagcttcctacctgctgaacttcttaatctggcaggatgctctaccgtcatccttgtctgcctacttaactcagcaagttgcatgtgataatggagataggcctgctgctgtggtggaaaggaacacattaatggttatcaaatgcttgatggaaaatcttgaggaagaagtatctcaggctgaaaattctctgcttcaggcagcagcagcatttccaatgtatgggcgagtccactgtataacaggagctttgcagaagttatctctaaacagcctgcagttggtgagcgagtggagacctgtggtagagaagctccttttgatgtcctacaggctttccactgtggtgtctccagtcattcagagctcatcccctgaaggcctcatcccaatggacactgattcagagtcagcaagccgcttacagatgattctgaatgagattcagcctcgagatactaatgattattttaaccaagccaaaatattgaaagaacatgatagctttgatatgaaggacttgaatgctagtgtggtgaatattgatacttctacagaaatcaaaggtaaagaagtaaaaacatgtgatgtaactgcgcagatggtgctggtatgttgttggagaagtatgaaggaagttgctttacttttaggcatgttgtgccagcttctgcccatgcagcctgtgccagaatcttctgatggattattgacggtggagcaggtaaaagaaataggagattactttaaacaacaccttttgcagtccaggcacagaggagcatttgaattggcttatactggttttgtgaaactcactgaagtactaaacaggtgcccaaatgtgagtctgcaaaagctgccagaacagtggctatggagtgttttagaggaaattaaatgcagtgatccttcatctaaactctgtgctacaaggcgcagtgctggaattcctttctacatacaggcactgttggcatctgaaccaaagaaaggcagaatggatttgttgaaaataacaatgaaagagttaatctctttggctgggcctacagatgacatacagagtacagtcccccaggttcatgctttaaatatccttagagcattgttcagagatacgcgcctgggagaaaatattattccttatgttgctgatggagctaaggctgcaattctgggttttacatcaccggtctgggcagtgcgaaattcatccacacttctctttagtgccttgatcacaagaatttttggagttaaaagggcaaaggatgaacattccaaaacaaatagaatgacagggagagagtttttctctcgtttcccagaactctatccttttcttctcaaacagttggaaactgtagccaatacagtagacagtgatatgggagaaccaaatcgtcatccaagcatgtttctcttacttttggtgttggagagactctacgcttccccgatggatggtacttcttctgctctcagcatgggaccttttgttcccttcattatgaggtgtggtcactcacctgtctaccactcccgtgaaatggcagctcgtgccttggtcccatttgttatgatagatcacattcctaataccattcgaactctgttgtccacactccccagctgcactgaccagtgtttccggcaaaaccacattcatgggacacttctccaggtttttcatttgttgcaagcctactcagactccaaacacggaacgaattcagacttccagcacgagctgactgacatcactgtttgtaccaaagccaaactctggctggccaagaggcaaaatccatgtttggtgaccagagctgtatatattgatattctcttcctattgacttgctgcctcaacagatctgcaaaggacaaccagccagttctggagagtcttggcttctgggaggaagtcagagggattatctcaggatcagagctgataacgggattcccttgggccttcaaggtgccaggcctgccccagtacctccagagcctcaccagactagccattgctgcagtgtgggccgcggcagccaagagtggagagcgggagacgaatgtccccatctctttctctcagctgttagaatctgccttccctgaagtgcgctcactaacactggaagccctcttggaaaagttcttagcagcagcctctggacttggagagaagggcgtgccacccttgctgtgcaacatgggagagaagttcttattgttggccatgaaggaaaatcacccagaatgcttctgcaagatactgaaaattctccactgcatggaccctggtgagtggcttccccagacggagcactgtgtccatctgaccccaaaggagttcttgatctggacgatggatattgcttccaatgaaagatctgaaattcagagtgtagctctgagacttgcttccaaagtcatttcccaccacatgcagacatgtgtggagaacagggaattgatagctgctgagctgaagcagtgggttcagctggtcatcttgtcatgtgaagaccatcttcctacagagtctaggctggccgtcgttgaagtcctcaccagtactacaccacttttcctcaccaacccccatcctattcttgagttgcaggatacacttgctctctggaagtgtgtccttacccttctgcagagtgaggagcaagctgttagagatgcagccacggaaaccgtgacaactgccatgtcacaagaaaatacctgccagtcaacaggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctag

SEQ ID NO: 207 - protein, 2217 aa, Artificial Sequence
  Synthetic Construct
MGVKKKKEMQVAALTICHQDLETLKSFADVEGKNLASLLLHCVQLTDGVSQIHYIKQIVPLLEKADKNGMCDPTIQSCLDILAGIYLSLSLKNPLKKVLASSLNSLPDFFLPEAMHRFTSRLQEELNTTDLYSYRKVTDNISSCMENFNLGRASVNNLLKNVLHFLQKSLIEILEENRKCAGNHIIQTQLMNDLLVGIRVSMMLVQKVQDFQGNLWKTSDSPIWQNMCGLLSIFTKVLSDDDLLQTVQSTSGLAIILFIKTMFHPSEKIPHLISSVLLRSVDCTSVPEWFMSSCRSLCCGDISQSAVLFLCQGTLAMLDWQNGSMGRSGEALLLDTAHVLFTLSSQIKEPTLEMFLSRILASWTNSAIQVLESSSPSLTDSLNGNSSIVGRLLEYVYTHWEHPLDALRHQTKIMFKNLLQMHRLTVEGADFVPDPFFVELTESLLRLEWHIKGKYTCLGCLVECIGVEHILAIDKTIPSQILEVMGDQSLVPYASDLLETMFRNHKSHLKSQTAESSWIDQWHETWVSPLLFILCEGNLDQKSYVIDYYLPKLLSYSPESLQYMVKILQTSIDAKTGQEQSFPSLGSCNSRGALGALMACLRIARAHGHLQSATDTWENLVSDARIKQGLIHQHCQVRIDTLGLLCESNRSTEIVSMEEMQWIQFFITYNLNSQSPGVRQQICSLLKKLFCRIQESSQVLYKLEQSKSKREPENELTKQHPSVSLQQYKNFMSSICNSLFEALFPGSSYSTRFSALTILGSIAEVFHVPEGRIYTVYQLSHDIDVGRFQTLMECFTSTFEDVKILAFDLLMKLSKTAVHFQDSGKLQGLFQAALELSTSTKPYDCVTASYLLNFLIWQDALPSSLSAYLTQQVACDNGDRPAAVVERNTLMVIKCLMENLEEEVSQAENSLLQAAAAFPMYGRVHCITGALQKLSLNSLQLVSEWRPVVEKLLLMSYRLSTVVSPVIQSSSPEGLIPMDTDSESASRLQMILNEIQPRDTNDYFNQAKILKEHDSFDMKDLNASVVNIDTSTEIKGKEVKTCDVTAQMVLVCCWRSMKEVALLLGMLCQLLPMQPVPESSDGLLTVEQVKEIGDYFKQHLLQSRHRGAFELAYTGFVKLTEVLNRCPNVSLQKLPEQWLWSVLEEIKCSDPSSKLCATRRSAGIPFYIQALLASEPKKGRMDLLKITMKELISLAGPTDDIQSTVPQVHALNILRALFRDTRLGENIIPYVADGAKAAILGFTSPVWAVRNSSTLLFSALITRIFGVKRAKDEHSKTNRMTGREFFSRFPELYPFLLKQLETVANTVDSDMGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 208 - DNA, 2305 bp, Artificial Sequence
  Synthetic Construct
gcacagcagctgcacgcgccgtggctccggatctcttcgtctttgcagcgtagcccgagtcggtcagcgccggagacacatagagaactggcgcagtcttcacacgctcaacgccgtggacatggagctctacaccggacttcaaaagctgaccatcaagaactcaggacttcggagcattcagcccagagcctttgccaagaacccccatttgcgttatataaacctgtcaagtaaccggctcaccacactctcgtggcagctcttccagacgctgagtcttcgggaattgcagttggagcagaactttttcaactgcagctgtgacatccgctggatgcagctctggcaggagcagggggaggccaagctcaacagccagaacctctactgcatcaacgctgatggctcccagcttcctctcttccgcatgaacatcagtcagtgtgaccttcctgagatcagcgtgagccacgtcaacctgaccgtacgagagggtgacaacgctgttatcacttgcaatggctctggatcaccccttcctgatgtggactggatagtcactgggctgcagtccatcaacactcaccagaccaatctgaactggaccaatgttcatgccatcaacttgacgctggtgaatgtgacgagtgaggacaatggcttcaccctgacgtgcattgcagagaacgtggtgggcatgagcaatgccagtgttgccctcactgtctactatcccccacgtgtggtgagcctggaggagcctgagctgcgcctggagcactgcatcgagtttgtggtgcgtggcaaccccccaccaacgctgcactggctgcacaatgggcagcctctgcgggagtccaagatcatccatgtggaatactaccaagagggagagatttccgagggctgcctgctcttcaacaagcccacccactacaacaatggcaactataccctcattgccaaaaacccactgggcacagccaaccagaccatcaatggccacttcctcaaggagccctttccagagagcacggataactttatcttgtttgacgaagtgagtcccacacctcctatcactgtgacccacaaaccagaagaagacacttttggggtatccatagcagttggacttgctgcttttgcctgtgtcctgttggtggttctcttcgtcatgatcaacaaatatggtcgacggtccaaatttggaatgaagggtcccgtggctgtcatcagtggtgaggaggactcagccagcccactgcaccacatcaaccacggcatcaccacgccctcgtcactggatgccgggcccgacactgtggtcattggcatgactcgcatccctgtcattgagaacccccagtacttccgtcagggacacaactgccacaagccggacacgtatgtgcagcacattaagaggagagacatcgtgctgaagcgagaactgggtgagggagcctttggaaaggtcttcctggccgagtgctacaacctcagcccgaccaaggacaagatgcttgtggctgtgaaggccctgaaggatcccaccctggctgcccggaaggatttccagagggaggccgagctgctcaccaacctgcagcatgagcacattgtcaagttctatggagtgtgcggcgatggggaccccctcatcatggtctttgaatacatgaagcatggagacctgaataagttcctcagggcccatgggccagatgcaatgatccttgtggatggacagccacgccaggccaagggtgagctggggctctcccaaatgctccacattgccagtcagatcgcctcgggtatggtgtacctggcctcccagcactttgtgcaccgagacctggccaccaggaactgcctggttggagcgaatctgctagtgaagattggggacttcggcatgtccagagatgtctacagcacggattattacagggtgggaggacacaccatgctccccattcgctggatgcctcctgaaagcatcatgtaccggaagttcactacagagagtgatgtatggagcttcggggtgatcctctgggagatcttcacctatggaaagcagccatggttccaactctcaaacacggaggtcattgagtgcattacccaaggtcgtgttttggagcggccccgagtctgccccaaagaggtgtacgatgtcatgctggggtgctggcagagggaaccacagcagcggttgaacatcaaggagatctacaaaatcctccatgctttggggaaggccaccccaatctacctggacattcttggctag

SEQ ID NO: 209 - protein, 767 aa, Artificial Sequence
  Synthetic Construct
HSSCTRRGSGSLRLCSVARVGQRRRHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

What is claimed is:

1. A method of treating or delaying progression of cancer, comprising: detecting a neurotrophic receptor tyrosine kinase (NTRK) fusion nucleic acid molecule or an NTRK fusion polypeptide in a sample from an individual with cancer, wherein the NTRK fusion nucleic acid molecule encodes or is encoded by the nucleotide sequence of any one of SEQ ID NOs: 5, 11, 67, 71, and 118; and administering to the individual an effective amount of a treatment comprising a kinase inhibitor.

2. The method of claim 1, wherein the cancer is acute myeloid leukemia (AML), acute lymphoblastic leukemia (ALL), adenocarcinoma, adenocarcinoma of the lung, adrenocortical carcinoma, anal cancer, squamous cell carcinoma of the anus, appendiceal cancer, B-cell derived leukemia, B-cell derived lymphoma, bladder cancer, brain cancer, breast cancer, triple negative breast cancer (TNBC), non-triple negative breast cancer, cancer of the fallopian tubes, cancer of the testes, cerebral cancer, cervical cancer, squamous cell carcinoma of the cervix, cholangiocarcinoma, choriocarcinoma, chronic myelogenous leukemia, a CNS tumor, colon adenocarcinoma, colon cancer, colorectal cancer, colon adenocarcinoma, diffuse intrinsic pontine glioma (DIPG), diffuse large B cell lymphoma (DLBCL), embryonal rhabdomyosarcoma (ERMS), endometrial cancer, epithelial cancer, esophageal cancer, squamous cell carcinoma of the esophagus, Ewing's sarcoma, eye cancer, uveal melanoma, follicular lymphoma, gall bladder cancer, gastric cancer, gastrointestinal cancer, glioblastoma multiforme, glioma, lower grade glioma, head and neck cancer, squamous cell carcinoma of the head and neck (SCHNC), a hematological cancer, hepatocellular cancer, Hodgkin's lymphoma (HL), primary mediastinal B-cell lymphoma, kidney cancer, kidney clear cell cancer, kidney papillary cancer, kidney chromophobe cancer, large B-cell lymphoma, laryngeal cancer, leukemia, liver cancer, lung cancer, non-small cell lung cancer (NSCLC), small cell lung cancer, lung adenocarcinoma, squamous cell carcinoma of the lung, lymphoma, melanoma, Merkel cell carcinoma, mesothelioma, monocytic leukemia, multiple myeloma, myeloma, a neuroblastic-derived CNS tumor, neuroblastoma (NB), non-Hodgkin's lymphoma (NHL), non-small cell lung cancer (NSCLC), oral cancer, osteosarcoma, ovarian cancer, ovarian carcinoma, pancreatic cancer, peritoneal cancer, pheocromocytoma, primary peritoneal cancer, prostate cancer, relapsed or refractory classic Hodgkin's Lymphoma (cHL), renal cancer, renal cell carcinoma, rectal cancer, rectum carcinoma, salivary gland cancer, salivary gland tumor, sarcoma, skin cancer, small cell lung cancer, small intestine cancer, squamous cell carcinoma of the penis, soft tissue sarcoma, squamous cell carcinoma of the esophagus, squamous cell carcinoma of the head and neck (SCHNC), squamous cell carcinoma of the lung, stomach cancer, T-cell derived leukemia, T-cell derived lymphoma, testicular tumor, thymic cancer, a thymoma, thyroid cancer, thyroid carcinoma, uveal melanoma, urothelial cell carcinoma, uterine cancer, uterine endometrial cancer, uterine sarcoma, uterine carcinosarcoma, vaginal cancer, squamous cell carcinoma of the vagina, vulvar cancer, squamous cell carcinoma of the vulva, or Wilms tumor.

3. The method of claim 1, wherein the NTRK fusion nucleic acid molecule encodes or is encoded by the nucleotide sequence of SEQ ID NO: 5, and the cancer is ovarian carcinosarcoma.

4. The method of claim 1, wherein the NTRK fusion nucleic acid molecule encodes or is encoded by the nucleotide sequence of SEQ ID NO: 11, and the cancer is melanoma.

5. The method of claim 1, wherein the NTRK fusion nucleic acid molecule encodes or is encoded by the nucleotide sequence of SEQ ID NO:67, and the cancer is a primary serous carcinoma or soft tissue angiosarcoma.

6. The method of claim 1, wherein the NTRK fusion nucleic acid molecule encodes or is encoded by the nucleotide sequence of SEQ ID NO:71, and the cancer is a primary adenocarcinoma.

7. The method of claim 1, wherein the NTRK fusion nucleic acid molecule encodes or is encoded by the nucleotide sequence of SEQ ID NO: 118, and the cancer is urothelial carcinoma.

8. The method of claim 1, wherein the cancer is a colorectal cancer, and the colorectal cancer comprises high microsatellite instability (MSI).

9. The method of claim 1, wherein the cancer does not have an alteration in one or more of ALK, BRAF, ERBB2, EGFR, ROS1, or KRAS and/or has no detectable altered level or activity of one or more of EGFR, KRAS, ALK, ROS1 or RET.

10. The method of claim 1, wherein the cancer comprises a tumor mutational burden (TMB) of 5 mut/Mb or more.

11. The method of claim 1, wherein the kinase inhibitor is AG 879 (Tyrphostin AG 879), an anti-TrK antibody, ARRY 954, AR523, AZ-23, AZ623, a benzotriazole, CEP-2563, danusertib (PHA-739358), entrectinib (also known as RXDX-101 or NMS-E628), DS-6051, GNF 5837, GW 441756, indenopyrrolocarboazole 12a, isothiazole 5n, larotrectinib (previously known as LOXO-101 or ARRY-470), lestaurtinib (CEP-701), LOXO-195, a macrocyclic compound, ONO-5390556, oxindole 3, pegcantratinib (SNA-120), PHA-848125, PLX7486, a pyrazole derivative, a pyrazolo [1, 5a] pyrimidine, a pyridocarbazole, a pyridoquinazolinyl, a pyridotriazole, a pyrrolidinyl thiourea, a pyrrolidinyl urea, a pyrrolo [2, 3-d]pyrimidine, a quinazolinyl, repotrectinib, Ro 08-2750, a substituted pyrazolo [1,5a] pyrimidine, sitravatinib, SNA-125, tavilermide, thiazole 20h, ARRY-772, AZD7451, belizatinib, selitrectinib, crizotinib, ONO-7579, merestinib, ensartinib, TSR-011, MGCD516, altiratinib, cabozantinib, XL-184, DCC-2701, F17752, regorafenib, dovitinib, BMS-754807, ENMD-2076, BMS-777607, midostaurin, MK5108, PF-03814735, SNS-314, nintedanib, ponatinib, foretinib, AZD 1480, or VMD-928.

12. The method of claim 11, wherein the kinase inhibitor is larotrectinib, AZ-23, danusertib (PHA-739358), entrectinib, lestaurtinib (CEP-701), AZD7451, belizatinib, selitrectinib, or crizotinib.

13. The method of claim 1, further comprising administering a second therapeutic agent to the individual.

14. The method of claim 13, wherein the second therapeutic agent comprises an HSP90 inhibitor, chemotherapeutic agent, anti-hormonal agent, antimetabolite chemotherapeutic agent, kinase inhibitor, methyltransferase inhibitor, peptide, gene therapy, vaccine, platinum-based chemotherapeutic agent, immunotherapy, antibody, or checkpoint inhibitor.

15. The method of claim 14, wherein the HSP90 inhibitor comprises one or more of 17-AAG, 17-DMAG, AT-13387, AUY-922, BIIB-021 (CNF-2024), BIIB-028, CCT-018159, CCT-129397, CNF-1010, CU-0305, Geldanamycin, IPI-504, Macbecin I, Macbecin II, MPC-3100, PF-04928473 (SNX-2112), Pochonin, PU-H71, Radanamycin, Radicol, SanA, di-SanA, SNX-5422, STA-9090, or XL-888.

16. The method of claim 1, wherein the sample comprises fluid, cells, tissue, a tumor biopsy, a circulating tumor cell, a circulating tumor nucleic acid, a nucleic acid sample, or a protein sample.

17. The method of claim 16, wherein the NTRK fusion nucleic acid molecule is detected in the sample by a nucleic acid hybridization assay, an amplification-based assay, a PCR-RFLP assay, real-time PCR, sequencing, a screening analysis, FISH, spectral karyotyping or MFISH, comparative genomic hybridization, in situ hybridization, sequence-specific priming (SSP) PCR, HPLC, and/or mass-spectrometric genotyping.

* * * * *